US012534745B2

(12) United States Patent
Han et al.

(10) Patent No.: US 12,534,745 B2
(45) Date of Patent: Jan. 27, 2026

(54) LIPOXYGENASE-CATALYZED PRODUCTION OF UNSATURATED $C_{10}$-ALDEHYDES FROM POLYUNSATRURATED FATTY ACIDS

(71) Applicant: FIRMENICH SA, Satigny (CH)

(72) Inventors: Lei Han, Shanghai (CN); Qi Wang, Shanghai (CN); Olivier Haefliger, Satigny (CH); Didier Belorgey, Shanghai (CN); Christoph Cerny, Shanghai (CN)

(73) Assignee: FIRMENICH SA, Satigny (CH)

( * ) Notice: Subject to any disclaimer, the term of this patent is extended or adjusted under 35 U.S.C. 154(b) by 981 days.

(21) Appl. No.: 17/286,051

(22) PCT Filed: Oct. 18, 2019

(86) PCT No.: PCT/EP2019/078370

§ 371 (c)(1),
(2) Date: Apr. 16, 2021

(87) PCT Pub. No.: WO2020/079223

PCT Pub. Date: Apr. 23, 2020

(65) Prior Publication Data

US 2022/0042051 A1 Feb. 10, 2022

(30) Foreign Application Priority Data

Oct. 19, 2018 (WO) ................ PCT/CN2018/110960

(51) Int. Cl.

| | |
|---|---|
| ***C12N 9/02*** | (2006.01) |
| ***A23K 20/105*** | (2016.01) |
| ***A23L 27/20*** | (2016.01) |
| ***C12P 7/24*** | (2006.01) |

(52) U.S. Cl.

CPC .............. *C12P 7/24* (2013.01); *A23K 20/105* (2016.05); *A23L 27/2024* (2016.08); *C12N 9/0069* (2013.01); *C12Y 113/11* (2013.01); *A23V 2002/00* (2013.01)

(58) Field of Classification Search

None

See application file for complete search history.

(56) References Cited

U.S. PATENT DOCUMENTS 6,762,163 B2 7/2004 Naef et al.

FOREIGN PATENT DOCUMENTS

| | | | | |
|---|---|---|---|---|
| CN | 107529803 A | 1/2018 | | |
| JP | S6486884 A | 3/1989 | | |
| JP | H0789937 B2 | 10/1995 | | |
| JP | 2003522223 A | 7/2003 | | |
| WO | 0139614 A1 | 6/2001 | | |
| WO | WO-2004007732 * | 1/2004 | ......... | C12N 15/8247 |
| WO | WO-2004007732 A1 * | 1/2004 | ......... | C12N 15/8247 |

OTHER PUBLICATIONS

Ngo et al. in The Protein Folding Problem and Tertiary Structure Prediction, 1994, Merz et al. (ed.), Birkhauser, Boston, MA, pp. 433 and 492-495.*

Okano et al., (Uniprot A0A2L2XME8, Apr. 25, 2018).*

International Search Report and Written Opinion for corresponding PCT/EP2019/078370 mailed Feb. 14, 2020, 19 pages.

N.N., "Lipoxygenase family protein", UniProt2013, Database accession No. UniProtKB—L7E8T2 XP002797244.

Özkaya et al, "Characterization of the free and glycosidically bound aroma potential of two important tomato cultivars grown in Turkey", Journal of Food Science and Technology, vol. 55, Aug. 28, 2018 (Aug. 28, 2018), p. 4440-4449.

Alsufyani et al, "Prevalence and mechanism of polyunsaturated aldehydes production in the green tide forming macroalgal genus Ulva (Ulvales, Chlorophyta)", Chemistry and Physics of Lipids, vol. 183, 2014, p. 100-109.

Mandal et al, "In vitro kinetics of soybean lipoxygenase with combinatorial fatty substrates and its functional significance in off flavour development", Food Chemistry, vol. 146, 2014, p. 394-403,.

Adolph et al, "Synthesis and biological activity of alpha, beta, gamma, delta-unsaturated aldehydes from diatoms", Tetrahedron, vol. 59, 2003, p. 3003-3008.

Andrianarison et al, "Oxodiene formation during the Vicia sativa lipoxygenase-catalyzed reaction: occurrence of dioxygenase and fatty acid lyase activities associated in a single protein", Biochemical and Biophysical Research Communications, vol. 180, 1991, p. 1002-1009.

St. Angelo et al, "Identification of lipoxygenase-linoleate decomposition products by direct gas chromatography-mass spectrometry", Lipids, vol. 15, 1980, p. 45-49.

Boonprab et al, "11-hydroperoxide eicosanoid-mediated 2(E),4(E)-decadienal production from archidonic acid in the brown algae, Saccharina angustata", Journal of Applied Phycology, vol. 31, Mar. 9, 2019 (Mar. 9, 2019), p. 2719-2727.

UniProt, "Arachidonate 15-lipoxygenase"; Retrieved on Oct. 18, 2023: https://www.uniprot.org/uniprotkb/A0A0C2CQ24/entry.

UniProt, "Lipoxygenase family protein"; Retrieved on Oct. 18, 2023: https://www.uniprot.org/uniprotkb/L7E8T2/entry.

(Continued)

*Primary Examiner* — Richard G Hutson

(74) *Attorney, Agent, or Firm* — Armstrong Teasdale LLP

(57) ABSTRACT

Described herein are methods for the lipoxygenase (LOX)-catalyzed production of aliphatic unsaturated $C_{10}$-aldehyde compounds from polyunsaturated fatty acid (PUFA) sources, and the isolation and characterization of novel, preferably bifunctional LOXs from different algae sources and the identification of structurally and/or functionally related LOXs from different bacterial sources. Also described herein are the provision of enzyme mutants derived from the newly identified enzymes, and corresponding coding sequences of the enzymes, recombinant vectors, and recombinant host cells suitable for the production of such LOXs and for performing the novel production methods of aliphatic unsaturated $C_{10}$-aldehyde compounds. Further describes herein is the use of particular aldehydes or aldehyde mixtures as a flavor ingredient or ingredient for food or feed compositions.

8 Claims, 20 Drawing Sheets

Specification includes a Sequence Listing.

(56) References Cited

OTHER PUBLICATIONS

UniProt, “Arachidonate 15-lipoxygenase”; Retrieved on Oct. 18, 2023: https://www.uniprot.org/uniprotkb/K9VMV7/entry.
National Library of Medicine, “Multispecies: lipoxygenase family protein [Microcystis]”; Retrieved on Oct. 18, 2023: https://www.ncbi.nlm.nih.gov/protein/WP_002738122.1.

* cited by examiner 2E,4Z,7Z-decatrienal, CAS: 43108-49-2

2E,4E,7Z-decatrienal, CAS: 66642-86-2

2E,4Z-decadienal, CAS: 25152-83-4

2E,4E-decadienal, CAS: 25152-84-5

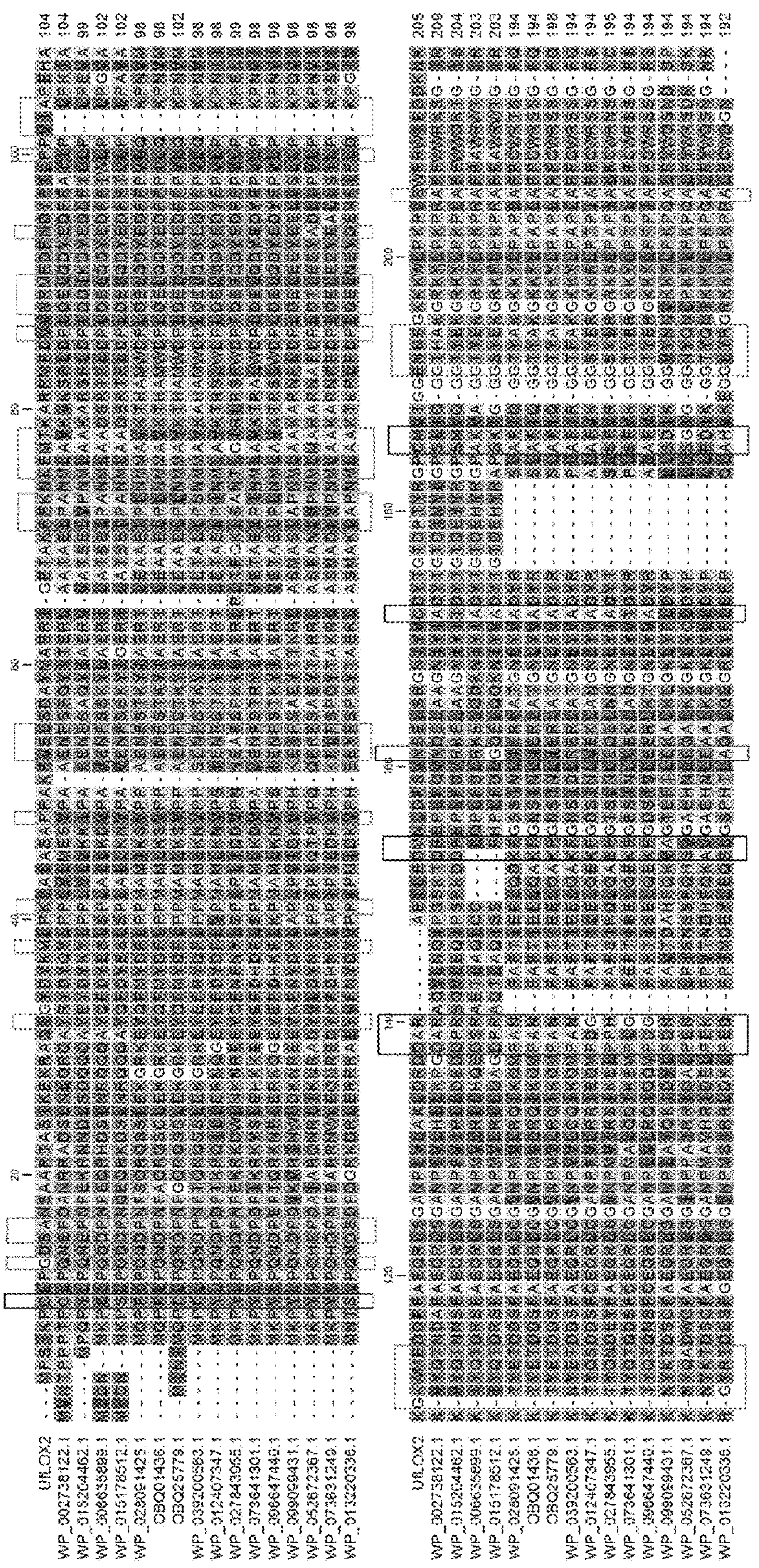
Fig. 11 (1)

Alignment for SEQ ID NO: 51

Alignment for SEQ ID NO: 52

Alignment for SEQ ID NO: 53

Fig. 17

Alignment for SEQ ID NO: 54

```
WP_002738122.1 -------------------------------------------------------------------------------- 0
WP_006635899.1 -------------------------------------------------------------------------------- 0
WP_015178512.1 -------------------------------------------------------------------------------- 0
WP_015204462.1 -------------------------------------------------------------------------------- 0
WP_028091425.1 -------------------------------------------------------------------------------- 0
OBQ01436.1     -------------------------------------------------------------------------------- 0
OBQ25779.1     -------------------------------------------------------------------------------- 0
WP_039200563.1 -------------------------------------------------------------------------------- 0
WP_012407347.1 -------------------------------------------------------------------------------- 0
WP_027843955.1 -------------------------------------------------------------------------------- 0
WP_073641301.1 -------------------------------------------------------------------------------- 0
WP_096647440.1 -------------------------------------------------------------------------------- 0
WP_099099431.1 -------------------------------------------------------------------------------- 0
WP_052672367.1 -------------------------------------------------------------------------------- 0
WP_073631249.1 -------------------------------------------------------------------------------- 0
WP_013220336.1 -------------------------------------------------------------------------------- 0
UfLOX2                                                                                          0
CoLOX-0317     MISSPTVRSMVMLAVLAVYALESTPCASAFATLPRALVRPQAALKYRAEDKNDVDVAPAGSTASDVSKPEGKATAVAKGT 80
CoLOX-22       MISSPTVRSNVMLAVLAVSALESAPCASAFATLPRALVRPQAALKYRAEDKNDVDVAPAGSTASDVSKPEGKATAVAKGT 80
CoLOX-19       MISSPTVRSMVMLAVLAVSALESAPCASAFATLPRALVRPQAALKYRAEDKNDVDVAPAGSTASDVSKPEGKATAVAKGT 80
CoLOX-3        MISSPTVRSMVMLAVLAVSALESAPCASAFATLPRALVRPQAALKYRAEDKNDVDVAPAGSTASDVSKPEGKATAVAKGT 80
CoLOX-d4       MISSPTVRSMVMLAVLAVSALESAPCASAFATLPRALVRPQAALKYRAEDKNDVDVAPAGSTASDVSKPEGKATAVAKGT 80

WP_002738122.1 -------------------------------------------------------------------------------- 0
WP_006635899.1 -------------------------------------------------------------------------------- 0
WP_015178512.1 -------------------------------------------------------------------------------- 0
WP_015204462.1 -------------------------------------------------------------------------------- 0
WP_028091425.1                                                                                  0
OBQ01436.1     -------------------------------------------------------------------------------- 0
OBQ25779.1     -------------------------------------------------------------------------------- 0
WP_039200563.1 -------------------------------------------------------------------------------- 0
WP_012407347.1 -------------------------------------------------------------------------------- 0
WP_027843955.1 -------------------------------------------------------------------------------- 0
WP_073641301.1 -------------------------------------------------------------------------------- 0
WP_096647440.1 -------------------------------------------------------------------------------- 0
WP_099099431.1 -------------------------------------------------------------------------------- 0
WP_052672367.1 -------------------------------------------------------------------------------- 0
WP_073631249.1 -------------------------------------------------------------------------------- 0
WP_013220336.1 -------------------------------------------------------------------------------- 0
UfLOX2         -------------------------------------------------------------------------------- 0
CoLOX-0317     VNAPIEEAWKVFRSFSNMNQWMPVYGEWEATGDSVGDIRTFNFKDQPTFFTIERLVGLDDSQYKMKYTLVNCKGSPVPIE 160
CoLOX-22       VNAPIEEAWKVFRSFSNMNQWMPVYGEWEATGDSVGDTRTFNFKDQPTFFTTERLVGLDDSQYKMKYTLVDCKGSPVPIE 160
CoLOX-19       VNAPIEEAWKVFRSFSNMDQWMPVYGEWEATGDSVGDIRTFNFKDQPTFFTIERLVGLDDSQYKMKYTLVDCKGSPVPIE 160
CoLOX-3        VNAPIEEAWKVFRSFSNMNQWMPVYGEWEATGDSVGDTRTFNFKDQPTFFTTERLVGLDDSQYKMKYTLVNCKGSPVPIE 160
CoLOX-d4       VNAPIEEAWKVFRSFSNMDQWMPVYGEWEATGDSVGDTRTFNFKDQPTFFTTERLVGLDDSQYKMKYTLVDCKGSPVPIE 160

WP_002738122.1 ----------------------------------------------------------------------MVNTRPPTPC 10
WP_006635899.1 ----------------------------------------------------------------------MVDN--MKPL 8
WP_015178512.1 ----------------------------------------------------------------------MVDN--MKPS 6
WP_015204462.1 ---------------------------------------------------------------------------MPQPY 5
WP_028091425.1 ----------------------------------------------------------------------------MQPF 4
OBQ01436.1     ----------------------------------------------------------------------------MQPF 4
OBQ25779.1     ------------------------------------------------------------------------MINTNQPF 8
WP_039200563.1 ----------------------------------------------------------------------------MKPS 4
WP_012407347.1 ----------------------------------------------------------------------------MKPY 4
WP_027843955.1 ----------------------------------------------------------------------------MKPY 4
WP_073641301.1 ----------------------------------------------------------------------------MKPY 4
WP_096647440.1 ----------------------------------------------------------------------------MKPY 4
WP_099099431.1 ----------------------------------------------------------------------------MKPY 4
WP_052672367.1 ----------------------------------------------------------------------------NKPY 4
WP_073631249.1 ----------------------------------------------------------------------------MKPY 4
WP_013220336.1 ----------------------------------------------------------------------------MNTS 4
UfLOX2         -------------------------------------------------------------------------MPSIKPC 7
CoLOX-0317     SIDTIVTFTANDDVTEVDWRSWTKSPMVDLIKGRQAAGYAGGIAALDRYLNPSLGTVDVTIKSADNLDGNFLSSSYATLM 240
CoLOX-22       SIDTIVTFTANDDVTEVDWRSWTKSPMVDLIKGRQAAGYAGGIAALDRYLNPSLGTVDVTIKSADNLDGDFLSSSYATLM 240
CoLOX-19       SIDTIVTFTANDDVTEVDWRSWTKSPMVDLIKGRQAAGYAGGIAALDRYLNPSLGTVDVTIKSADNLDGDFLSSSYATLM 240
CoLOX-3        SIDTIVTFTANDDVTEVDWRSWTKSPMVDLIKGRQAAGYAGGIAALDRYLNPSLGTVDVTIKSADNLDGDFLSSSYATLM 240
CoLOX-d4       SIDTIVTFTANDDVTEVDWRSWTKSPMVDLIKGRQAAGYAGGIAALDRYLNPSLGTVDVTIKSADNLDGDFLSSSYATLM 240

WP_002738122.1 PQNEP ANRRADS---------------------------- NLQRQAYRYDYQYLPPLVLNESVPA-AENFSFQYITER 62
WP_006635899.1 PQDDP PDQRDDC                             NRQQQAYQFDYESLSPLALLKDVPA VENFSSKYIAER 60
WP_015178512.1 PQDDP QEQRKDS---------------------------- NRQQQAYQFDYESLSPLALLKNVPA-VENFSSKYIGER 60
WP_015204462.1 PQNEP PEKRNND---------------------------- SQQQQAYEYDYKYLPPLVLLKKIPA-PENFSAQYLAER 57
WP_028091425.1 PQNDP PSQRQSS---------------------------- EKGRKEYQFNYDPLPPMAMLKSVPP-AENFSTKYTAER 56
OBQ01436.1     PQNDP PAQRQSC---------------------------- EKGRKEYQFMYDPLPPMAMLKSVPP-AENFSTKYIAER 56
OBQ25779.1     PQNDP PGQRQSS---------------------------- EKGRKEYQFNYDPLPPMAMLKSVPP-AENFSTKYIAER 60
WP_039200563.1 PQNDP PIQRQSS---------------------------- EKGRKEYEFRYDPLPPMAMLKNVPP-SENFSTKYIAER 56
WP_012407347.1 PQNDP PTKRQIL---------------------------- ERNQGEYEFDYDPLVPMAMLKNVPS-IENFSTKYIAER 56
WP_027843955.1 PQNDP PEKRKDW---------------------------- NKNREEYQFNFNYLSPLPLLIDDVPN-NEAFSPKYLAER 56
WP_073641301.1 PQNDP PIKRKYS---------------------------- RRKKPPYPFDHDPLSPNAMLKDVPA-VENFSTRYIAER 56
WP_096647440.1 PQNDP PTQRKNF---------------------------- ERKQGEYEFDHKFLKPMAMLKNVPS-IENFSIKYIAER 56
WP_099099431.1 PQKDT VKVRINW---------------------------- DKNREEYKENYDYLAPLPVIDKVPH-KETFSAEYTTKR 56
WP_052672367.1 PQHEP ATARQNR---------------------------- IKNRADYVIDYNYLPPIPLQTPVPQ-QERFSAEYTARR 56
WP_073631249.1 PQEDP PEARRNW---------------------------- EQNREDYKEDHNYLAPIPILDKVPH-KELFSPQYTAKR 56
WP_013220336.1 PQKDS PQGRKDR---------------------------- ERRRALYVFNYLYVPPIPMIDKVPH-EEYFSPKYTAER 56
UfLOX2         PGDSA SAARTAS---------------------------- KEKRAQIGYDYKMLPKLALASAPPAKFVELSDAYMAER 60
CoLOX-0317     IDADP QVHAKEWGTSPEFDAKPVQFSLLKPDSKLYMSVM TKYGVDTPVGYAVFDIQKSLKSGETVTETFQLEGSNDA 320
CoLOX-22       IDADP QVHAKEWGTSPEFDAKPVQFSLLKPDSKLYMSVM TKCGVDAPVGYAVFDIQKSLKSGETVIEIFQLEGSNDA 320
CoLOX-19       IDADP QVHAKEWGTSPEFDAKPVQFSLLKPDSKLYMNVM TKYGVDTPVGYAVFDIQKSLKSGETVTETFQLEGSNDA 320
CoLOX-3        IDADP QVHAKEWGTSPEFDAKPVQFSLLKPDSKLYMSVM TKCGVDAPVGYAVFDIQKSLKSGETVIEIFQLEGSNDA 320
```

```
OBQ25779.1      NKGRLVNYEYLQPRLLLNSISI 552
WP_039200563.1  NKGRLVNYEYLQPRLIINSISI 547
WP_012407347.1  NKSRLLNYNYLKPRLVTNSISV 547
WP_027843955.1  NKNRLVEYNFLKPSLVLNSISI 552
WP_073641301.1  NKSRLIKYNYLKPRLVTNSISV 547
WP_096647440.1  NKSRLINYDYLKPRLVTNSISV 547
WP_099099431.1  NQTRPIPYNYFKPSQIINSINT 546
WP_052672367.1  NQIRPIPYNYLKPSPIMNSINT 543
WP_073631249.1  NQSRPIPYNYLKPSEIINSINT 546
WP_013220336.1  NQDRPLAYTYLKPSEIINSINT 539
UfLOX2          NAKRPNNYPYMQQSEMLNSISI 582
CoLOX-0317      NKGLASPYEVLLPSHIAASINI 914
CoLOX-22        NKGLASPYEVLLPSHIAASINI 914
CoLOX-19        NKGLASPYEVLLPSHIAASINI 914
CoLOX-3         NKGLASPYEVLLPSHIAASINI 914
CoLOX-d4        NKGLASPYEVLLPSHIAASINI 914
```

Fig. 17 (cont.)

LIPOXYGENASE-CATALYZED PRODUCTION OF UNSATURATED $C_{10}$-ALDEHYDES FROM POLYUNSATRURATED FATTY ACIDS

CROSS-REFERENCE TO RELATED APPLICATIONS

This application is a U.S. National Phase application of International Patent Application No. PCT/EP2019/078370, filed Oct. 18, 2019, which claims the benefit of priority to International Patent Application No. PCT/CN2018/110960, filed Oct. 19, 2018, the entire contents of each of which are hereby incorporated by reference herein.

REFERENCE TO AN ELECTRONIC SEQUENCE LISTING

The contents of the electronic sequence listing (Revised_Seq_Listing_36803-289.txt; Size: 1,581,474 bytes; and Date of Creation: Sep. 21, 2021) is herein incorporated by reference in its entirety.

TECHNICAL FIELD

The present invention provides novel methods for the lipoxygenase (LOX)-catalyzed production of aliphatic unsaturated $C_{10}$-aldehyde compounds from polyunsaturated fatty acid (PUFA) sources. The present invention also relates to the isolation and characterization of novel, preferably bifunctional LOXs from different algae sources and the identification of structurally and/or functionally related LOXs from different bacterial sources. The present invention also relates to the provision of enzyme mutants derived from said newly identified enzymes. A further aspect of the present invention relates to corresponding coding sequences of said enzymes, recombinant vectors, and recombinant host cells suitable for the production of such LOXs and for performing the novel production methods of aliphatic unsaturated $C_{10}$-aldehyde compounds. Another aspect of the invention relates to the use of particular aldehydes or aldehyde mixtures, as obtained according to the present invention as flavor ingredient or ingredient for food or feed compositions.

BACKGROUND

The unsaturated $C_{10}$-aldehydes decadienal and decatrienal are very important ingredients for chicken and citrus flavours. In spite of high production costs and low production volumes, flavorists cannot replace them with other ingredients due to their unique olfactory properties. More than 200 commercial formulas contain $C_{10}$-aldehydes.

$C_6$ and $C_9$ aldehydes are typically biosynthesised by plant defensive systems through a two-step enzymatic reaction starting from polyunsaturated fatty acids (PUFAs) (see Scheme 1 below). First, LOXs convert fatty acids to fatty acid hydroperoxides (HPOs). Subsequently, hydroperoxide lyases (HPL) break down HPOs into metabolites including aldehydes and alcohols. The production of $C_6$ and $C_9$ ingredients by enzymes from plant extracts or enzymes from overexpressed microbial systems is well known. The industrial routes to manufacture $C_6$ and $C_9$ aldehyde flavour ingredients are relatively mature and the product quality is stable. Consequently, the prices remain lower than for $C_{10}$ analogs.

In comparison to the $C_6$ and $C_9$ analogues, the industrial process to manufacture $C_{10}$ aldehyde ingredients is more challenging (see Scheme 1 below, right half). It stats with the 9-LOX catalysed peroxidation of linoleic acid and alpha-linolenic acid. The 9-LOX is obtained from a plant source (potato). Considering that no HPL is available that would cleave the 9-HPO intermediates into $C_{10}$ fragments, a typical process currently relies instead on thermal degradation of 9-HPO. Overall, the approach has two drawbacks. One is product variation issues due to variations in the quality of the potato extracts from different suppliers, i.e. different yields achieved for each production batch since the enzyme content from potato is different. Another one is the low yield of the thermal cracking step which leads to high production costs.

Scheme 1

Current industrial production routes for $C_6$~$C_{10}$ aldehyde ingredients

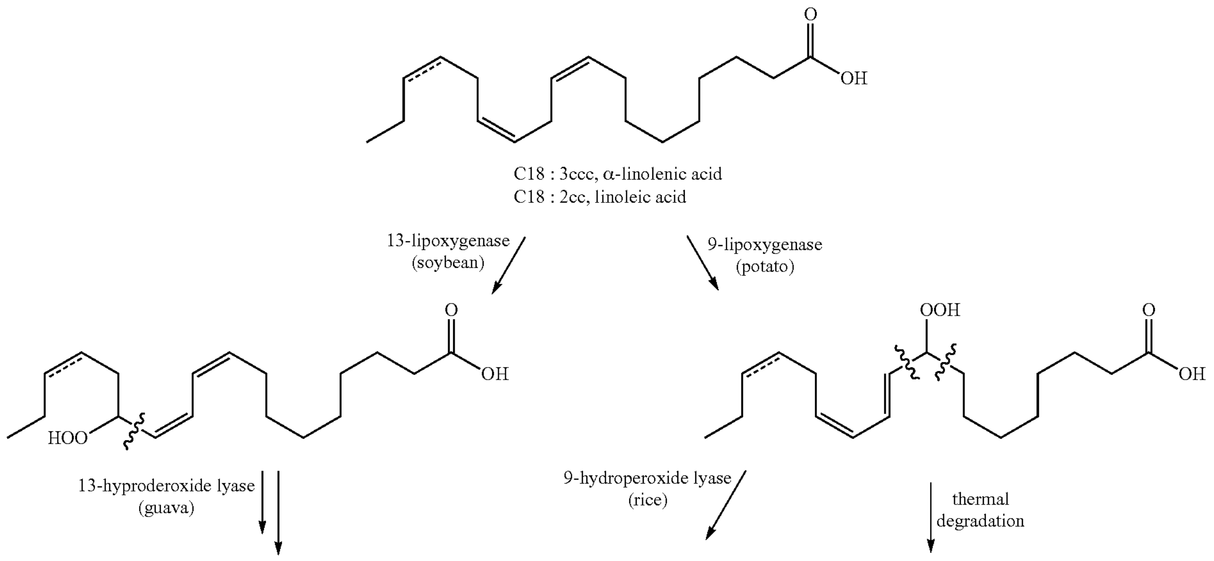

-continued

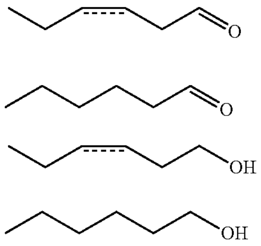

C6 Green notes

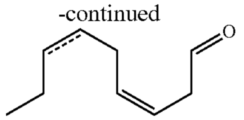

C9 aldehydes

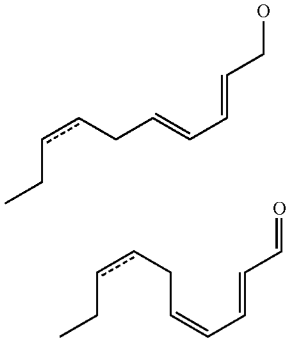

C10 aldehydes

Alsufyani, T. et al describe in Chemistry and Physics of Lipids 183 (2014) 100-109 several seaweeds including *Ulva* which could produce decadienals and decatrienals through the conventional LOX/HPL pathway. This prior art document doesn't identify any gene sequence, coding sequence, or protein sequence involved in said bioconversion or any key amino acid residues that determine high LOX activity.

Lee, J. et al provide in Environmental Pollution 227 (2017) 252e262 a review pertaining to algae and bacterial odor problems that have been published over the last five decades. Two *Microcystis* species (Cyanobacteria) were reported to produce decatrienal. While said prior art has its focus on odorant pollution in water no particular teaching on genes, coding sequences, or protein sequences responsible for said decatrienal formation is provided.

Zhu, Z-J. et al further investigate in Journal of Agriculture and Food Chemistry. (2018) 66(5):1233-1241 the multifunctional LOX, PhLOX from seaweed *Pyropia haitanensis* (also described by the Chen, Hai-min et al in Algal Research, 12, (2015) 316-327), in the one-step bioconversion of fatty acids to primarily $C_8$-$C_9$ aldehydes based on LOX activity and HPL activity. Said multifunctional LOX is said to show LOX, HPL and allene oxide synthase (AOS) activity. The production of a 2E,4Z-decadienal side product was observed merely by feeding with hydrolyzed fish oil but not with the numerous other testes substrates, like ALA, ARA, EPA and DHA. Decatrienals were not observed. Gamma-linolenic acid was not used as substrates in said prior art. The productivity of said decadienal side product is quite low and not of industrial value.

Zhu, et al describe in PLoS One. (2015) 10(2):e0117351) another multifunctional LOX, PhLOX2, from seaweed *Pyropia haitanensis*. EPA, ARA, GLA and DHA were investigated as substrates; no production of any unsaturated $C_{10}$ aldehyde was reported therein.

Chinese Patent Application CN 104293805 describes a multifunctional LOX protein sequence from seaweed *Pyropia haitanensis* (PhLOX) which was also expressed in *E. coli*. Said LOX species did not produce decadienals and decatrienals when feeding with fatty acid substrates. It only produces short chain aldehydes Chinese Patent Application CN 104293837 A describes another multifunctional LOX from seaweed *Pyropia haitanensis* (PhLOX) which was expressed in *E. coli*. No evidence for a production for $C_{10}$-aldehydes, in particular decadienals and decatrienals is provided therein.

WO2008056291 and EP-A-1921134 describe a cyanobacterial LOX, WP_012407347.1, and suggest its use in the production of fatty acid hydroperoxides, however do not provide evidence for the production of unsaturated $C_{10}$-aldehydes, like decadienal.

Despite of different reports on the biocatalytic synthesis of unsaturated $C_{10}$-aldehydes, the enzymatic systems described in the prior art still suffer from the problem of low productivity and, consequently, do not provide a suitable basis for the industrial scale production of $C_{10}$-aldehydes.

The problem to be solved by the present invention is, therefore, the provision of an improved biocatalytic method for the production of unsaturated $C_{10}$-aldehyde compounds, in particular decadienals and/or decatrienals. Another problem to be solved by the present invention is the provision of novel biocatalysts applicable in the fully biosynthetic production of unsaturated $C_{10}$-aldehydes, in particular decadienals and/or decatrienals.

SUMMARY

The above-mentioned problems could, surprisingly, be solved by providing unique and superior LOXs from new sources. In particular, the present inventors succeeded in isolating novel bi-functional LOXs from the seaweed sources *Cladophora oligoclara* producing high amounts of decadienals and/or decatrienals from different PUFA substrates. The present inventors also succeeded in isolating a novel bi-functional LOX from the seaweed *Ulva fasciata* which also produces high amounts of decadienals and/or decatrienals from different PUFA substrates.

On the basis of the sequence information derived from said new LOXs, the present inventors also surprisingly succeeded in the identification of LOXs with the desired catalytic LOX activity from bacterial sources, mainly from cyanobacteria.

On the basis of sequence comparisons between said newly identified enzymes, the present inventors were able to perform a systematic investigation on structure and functionality of suitable bifunctional LOXs showing superior productivity and/or specificity, for unsaturated $C_{10}$-aldehyde compounds, in particular decadienals and/or decatrienals, more particularly decadienals. Improved productivity was observed for several bacterial LOXs. On the basis of such investigations the inventors were able to further improve LOX productivity in the industrial production of such $C_{10}$-aldehydes.

The newly identified protein sequences may be functionally expressed in the bacterial hosts like *Escherichia coli*. Surprisingly, cultures with high cell density could be obtained with improved enzymatic capability for the industrial scale production of said $C_{10}$-aldehydes. Feeding with specific fatty acids as substrates, such recombinant *E. coli* hosts are highly productive in different decadienals and/or decatrienals.

The new approach allows the provision of more cost-effective methods for the fully biocatalytic production of decadienals and/or decatrienals.

If required said aldehydes may be converted to suitable derivatives, in particular to corresponding alcohols, by chemical or, in particular, biochemical conversion, for example by applying conventional alcohol dehydrogenase (ADH) enzymes.

ABBREVIATIONS USED

Figure 1:
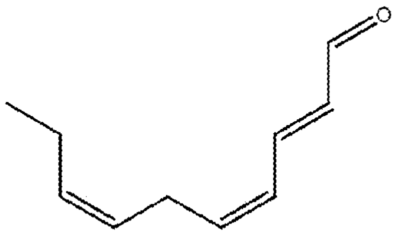
FIG. 1. Structural formulae of the unsaturated $C_{10}$ aldehyde stereoisomers 2E,4Z,7Z-decatrienal, 2E,4E,7Z-decatrienal, 2E,4Z-decadienal and 2E,4E-decadienal.
Figure 1:
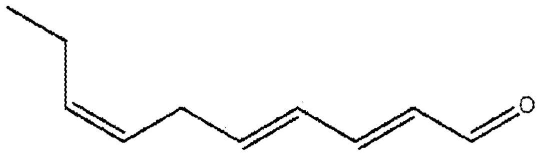
Figure 1:
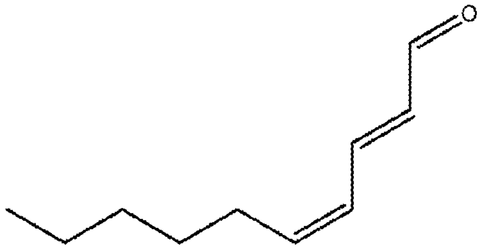
Figure 1:
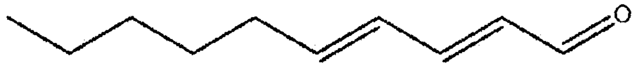

AOS allene oxide synthase
bp base pair
kb kilo base
DNA deoxyribonucleic acid
cDNA complementary DNA
GC gas chromatograph
HPO Hydroperoxide
HPL Hydroperoxide lyase
LOX Lipoxygenase
MS mass spectrometer/mass spectrometry
PUFA Polyunsaturated fatty acid
PCR polymerase chain reaction
RNA ribonucleic acid
mRNA messenger ribonucleic acid
miRNA micro RNA
siRNA small interfering RNA
rRNA ribosomal RNA
tRNA transfer RNAXaa (or X) as used in the sequence listings herein or attached to this description, refers to, unless otherwise specified, for any known natural amino acid residue or a chemical bond.

Particular PUFAs (PUFA substrates) as specifically referred to herein are selected from the following polyunsaturated omega-3 and omega-6 fatty acids and natural or synthetic mixtures of at least two of them:

| Omega-3 fatty acids | | |
|---|---|---|
| Common name (abbreviation) | Lipid name | Chemical name |
| | 16:4 (n-3) | all-cis hexadeca-4,7,10,13-tetraenoic acid, |
| Hexadecatrienoic acid (HTA) | 16:3 (n-3) | all-cis 7,10,13-hexadecatrienoic acid |
| Alpha-linolenic acid (ALA) | 18:3 (n-3) | all-cis-9,12,15-octadecatrienoic acid |
| Stearidonic acid (SDA) | 18:4 (n-3) | all-cis-6,9,12,15,-octadecatetraenoic acid |
| Eicosapentaenoic acid (EPA) | 20:5 (n-3) | all-cis-5,8,11,14,17-eicosapentaenoic acid |
| Docosahexaenoic acid (DHA) | 22:6 (n-3) | all-cis-4,7,10,13,16,19-docosahexaenoic acid |

| Omega-6 fatty acids | | |
|---|---|---|
| Common name (abbreviation) | Lipid name | Chemical name |
| Linoleic acid (LA) | 18:2 (n-6) | all-cis-9,12-octadecadienoic acid |
| Gamma-linolenic acid (GLA) | 18:3 (n-6) | all-cis-6,9,12-octadecatrienoic acid |
| Arachidonic acid (ARA) | 20:4 (n-6) | all-cis-5,8,11,14-eicosatetraenoic acid |

Non-limiting examples of particular PUFA mixtures as specifically referred to herein are selected from: fish oil, linseed oil, arachidonic acid oil, linseed oil, evening primrose oil echium oil, micro algae oil and borage oil.

Definitions

"Lipoxygenase" (LOX) (also designated linoleate: oxygen oxidoreductases, EC 1.13.11.12) constitute a large gene family of non-heme iron-containing fatty acid dioxygenases, which are ubiquitous in plants and animals. LOXs catalyze the regio- and stereospecific dioxygenation of PUFAs containing at least one (1Z,4Z)-pentadiene system. Thus, substrates for LOXs are for example linoleic acid (LA), alpha-linolenic acid (ALA), or arachidonic acid (ARA).

The term "LOX" as used herein specifically refers to such PUFA degrading enzymes which have the ability initiate a dioxygenation step in a suitable chain position of said PUFA molecule which ultimately results in the formation of at least one unsaturated $C_{10}$-aldehyde fragment, in particular at least one decadienal and/or decatrienals compound, as the result of such oxidative degradation reaction. Said $C_{10}$ compound(s) may be produced as side product (s) together with other oxidation product(s) of different chain length, for example of shorter chain lengths, as for example $C_6$- or $C_9$ unsaturated aldehydes, particularly however said $C_{10}$ compound(s) may be produced as predominant product (s), i.e. in an molar excess over other oxidation product of different, for example shorter chain lengths, as for example $C_6$- or $C_9$ unsaturated aldehydes, or more particularly said $C_{10}$ compound(s) may be produced as the single product species.

The "LOX/HPL pathway" or "LOX/HPL pathway" refers to the classical two-step enzymatic reaction for the oxidative degradation of polyunsaturated fatty acid molecules. First, LOXs (LOX) convert said fatty acids to fatty acid hydroperoxides (HPOs). Subsequently, HPLs (HPL) break down HPOs into metabolites including aldehydes and alcohols.

A "bifunctional" LOX designates herein a single enzyme molecule which shows both LOX and HPL activity required for the oxidative degradation of polyunsaturated fatty acid molecules (irrespective of a particular enzymatic mechanism). In a particular embodiment such bi-functional LOX may shows essentially no AOS activity, and more particularly may be absent of such AOS activity. As shown in the experimental section such bifunctional LOX do not only form fatty acid hydroperoxides intermediates they also show the ability to degrade such fatty acid hydroperoxides compounds if applied as synthetic artificial substrate. A "bifunctional" LOX in particular herein refers to a single enzyme molecule which shows both LOX and HPL activity required for the oxidative degradation of polyunsaturated fatty acid molecules (irrespective of a particular enzymatic mechanism). Thus said bifunctional LOX catalyzes the formation of at least one unsaturated $C_{10}$-aldehyde fragment, in particular at least one decadienal and/or decatrienals compound, as the result of such oxidative degradation reaction. Said $C_{10}$ compound(s) may be produced as side product(s) together with other oxidation product(s) of different chain length, for example of shorter chain lengths, as for example $C_6$- or $C_9$ unsaturated aldehydes, particularly however said Cu) compound(s) may be produced as predominant product(s), i.e. in an molar excess over other oxidation product of different, for example shorter chain lengths, as for example $C_6$- or $C_9$ unsaturated aldehydes, or more particularly said $C_{10}$ compound(s) may be produced as the single product species.

Without being bound to any mechanistic considerations, the HLP activity of a "Bifunctional LOX" of the present invention may be further described as the ability to exclusively or preferentially cleave the hydroperoxides intermediate of the PUFA substrate at the C—C bond on the carboxyl-terminal side relative to its the HOO— group. This distinguishes the present enzymes also from plant derived LOX/HLP enzyme systems, as for example depicted in the above Scheme 1. Starting out from LA or ALA (i.e. $C_{18}$-PUFAs) a bifunctional LOX of the invention may be considered to encompass both a 9-LOX activity and a 9-HPL activity. As opposed to the prior art 9-HLP of rice plants, the 9-HPL activity of the bifunctional LOX of the present invention, however, results in a cleavage of the hydroperoxides intermediate on the opposite (carboxyl-terminal) side of the HOO— group of the intermediate. For cleavage resulting in a $C_{10}$-aldehyde an extra double bond in beta-position relative to the HOO-group appears to be favorable or necessary, so that a cleavage of the carbon chain between the C-atom carrying the HOO-group and the carbon atom in alpha-position thereto will occur. As a result of this a $C_{10}$-aldehyde rather than a $C_9$-aldehyde as in the case of the plant enzyme is produced. This is illustrated below in Scheme 2 with GLA as an example.

Scheme 2

Comparison of cleavage sites of LOX enzyme of the invention (resulting in $C_{10}$ aldehyde formation) and prior art enzymes (resulting $C_9$ aldehyde formation)

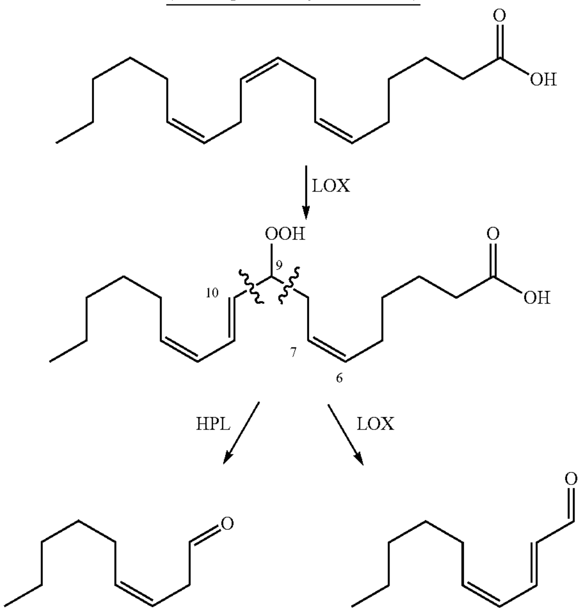

C9 aldehyde

C10 aldehyde (decadienal)

As is evident from the above Scheme 2 a "bifunctional LOX" of the present invention, in order to produce an unsaturated C10-aldehyde, utilizes particular PUFA substrates. Essentially, a preferred PUFA substrate should comprise cis-double bonds between omega-9 and 10 carbon atoms (i.e. between position (C-9) and (C-10) in C18 fatty acid and between position (C-11) and (C-12) in $C_{20}$ fatty acid) as well as between omega 12 and 13 carbon atoms (i.e. between position (C-6) and (C-7) in C18 fatty acid and between position (C-8) and (C-9) in C20 fatty acid). For example, in case of C18 fatty acids those comprising two cis double bonds in an all-cis-6, 9 configuration (cf. GLA and SDA) are preferred substrates, and in case of C20 fatty acids those comprising two cis double bonds an all-cis-8,11 configuration (cf. EPA or ARA) are preferred substrates. These preferred PUFA substrates may also be considered as "reference substrates". In order to qualify as a "bifunctional LOX of the present invention" it is sufficient if the LOX is able to convert at least one of such "reference substrate" to an unsaturated C10-aldehyde, in particular at least one selected from (2E,4Z)-2,4-decadienal, (2E,4E)-2,4-decadienal, (2E,4Z,7Z)-2,4,7-decatrienal and (2E,4E,7Z)-2,4,7-decatrienal.

An "unsaturated $C_{10}$-aldehyde" encompasses any mono-, di- or tri-unsaturated linear aliphatic aldehyde having ten carbon atoms in its hydrocarbyl chain. It encompasses such compound in any stereoisomerically pure form or in the form of mixtures of at least two different stereoisomers. Particular, non-limiting examples of such aldehydes are decadienals and decatrienals.

A "decadienal" encompasses such compound in any stereoisomerically pure form or in the form of mixtures of at least two different stereoisomers. Typical examples are 2E,4Z-decadienal and 2E,4E-decadienal and mixtures thereof.

A "decatrienal" encompasses such compound in any stereoisomerically pure form or in the form of mixtures of at least two different stereoisomers. Typical examples are 2E,4Z,7Z-decatrienal, 2E,4E,7Z-decatrienal and mixtures thereof.

The term "PUFA" as used herein has to be understood broadly. In particular it encompasses one single "pure" or "essentially pure" type of PUFA molecule (like HTA, ALA, SDA, EPA, LA, GLA, or ARA) or any mixture containing at least two different types of PUFAs. A PUFA substrate also encompasses natural products containing at least one PUFA typein admixture with other natural or synthetic constituents, as for example a) borage oil (containing elevated proportions of GLA)
b) evening primrose oil (containing elevated proportions of GLA)
c) arachidonic oil (containing elevated proportions of ARA)
d) echium seed oil (containing elevated proportions of SDA
e) fish oil (containing elevated proportions of EPA and DHA)
f) linseed oil (containing elevated proportions of ALA)
g) micro algae oil (containing elevated proportions of DHA)

"Bifunctional LOX Activity" is determined under "standard conditions" as described in the experimental section. In general, the LOX product GLA-HPO and HPL product hexanal, and decadienal were quantified by GC-MS and LC-UV by peak areas. To deduce bifunctional LOX activity to make decadienal, we can calculate the peak area ratio of decadienal to GLA-HPO from the LC-UV data as shown in Table 9.

The terms "biological function," "function", "biological activity" or "activity" of a LOX refer to the ability of a LOX as described herein to catalyze the formation of at least one unsaturated C10 aldehyde from at least one type of PUFA molecule.

As used herein, the term "host cell" or "transformed cell" refers to a cell (or organism) altered to harbor at least one nucleic acid molecule, for instance, a recombinant gene encoding a desired protein or nucleic acid sequence which upon transcription yields at least one functional polypeptide of the present invention, i.p. a LOX or bifunctional LOX as defined herein above. The host cell is particularly a bacterial cell, a fungal cell or a plant cell or plants. The host cell may contain a recombinant gene or several genes, as for example organized as an operon, which has been integrated into the nuclear or organelle genomes of the host cell. Alternatively, the host may contain the recombinant gene extra-chromosomally.

The term "organism" refers to any non-human multicellular or unicellular organism such as a plant, or a microorganism. Particularly, a micro-organism is a bacterium, a yeast, an algae or a fungus.

The term "plant" is used interchangeably to include plant cells including plant protoplasts, plant tissues, plant cell tissue cultures giving rise to regenerated plants, or parts of plants, or plant organs such as roots, stems, leaves, flowers, pollen, ovules, embryos, fruits and the like. Any plant can be used to carry out the methods of an embodiment herein.

A particular organism or cell is meant to be "capable of producing" an unsaturated $C_{10}$ aldehyde when it produces such aldehyde naturally or when it does not produce such aldehyde naturally but is transformed to produce such aldehyde with a nucleic acid as described herein. Organisms or cells transformed to produce a higher amount of such aldehyde than the naturally occurring organism or cell are also encompassed by the "organisms or cells capable of producing unsaturated $C_{10}$ aldehyde".

For the descriptions herein and the appended claims, the use of "or" means "and/or" unless stated otherwise. Similarly, "comprise", "comprises", "comprising", "include", "includes", and "including" are interchangeable and not intended to be limiting.

It is to be further understood that where descriptions of various embodiments use the term "comprising," those skilled in the art would understand that in some specific instances, an embodiment can be alternatively described using language "consisting essentially of" or "consisting of".

The terms "purified", "substantially purified", and "isolated" as used herein refer to the state of being free of other, dissimilar compounds with which a compound of the invention is normally associated in its natural state, so that the "purified", "substantially purified", and "isolated" subject comprises at least 0.5%, 1%, 5%, 10%, or 20%, or at least 50% or 75% of the mass, by weight, of a given sample. In one embodiment, these terms refer to the compound of the invention comprising at least 95, 96, 97, 98, 99 or 100%, of the mass, by weight, of a given sample. As used herein, the terms "purified," "substantially purified," and "isolated" when referring to a nucleic acid or protein, or nucleic acids or proteins, also refers to a state of purification or concentration different than that which occurs naturally, for example in an prokaryotic or eukaryotic environment, like, for example in a bacterial or fungal cell, or in the mammalian organism, especially human body. Any degree of purification or concentration greater than that which occurs naturally, including (1) the purification from other associated structures or compounds or (2) the association with structures or compounds to which it is not normally associated in said prokaryotic or eukaryotic environment, are within the meaning of "isolated". The nucleic acid or protein or classes of nucleic acids or proteins, described herein, may be isolated, or otherwise associated with structures or compounds to which they are not normally associated in nature, according to a variety of methods and processes known to those of skill in the art.

The term "about" indicates a potential variation of ±25% of the stated value, in particular ±15%, ±10%, more particularly ±5%, ±2% or ±1%.

The term "substantially" describes a range of values of from about 80 to 100%, such as, for example, 85-99.9%, in particular 90 to 99.9%, more particularly 95 to 99.9%, or 98 to 99.9% and especially 99 to 99.9%.

"Predominantly" refers to a proportion in the range of above 50%, as for example in the range of 51 to 100%, particularly in the range of 75 to 99.9%, more particularly 85 to 98.5%, like 95 to 99%.

A "main product" in the context of the present invention designates a single compound or a group of at least 2 compounds, like 2, 3, 4, 5 or more, particularly 2 or 3 compounds, which single compound or group of compounds is "predominantly" prepared by a reaction as described herein, and is contained in said reaction in a predominant proportion based on the total amount of the constituents of the product formed by said reaction. Said proportion may be a molar proportion, a weight proportion or, preferably based on chromatographic analytics, an area proportion calculated from the corresponding chromatogram of the reaction products.

A "side product" in the context of the present invention designates a single compound or a group of at least 2 compounds, like 2, 3, 4, 5 or more, particularly 2 or 3 compounds, which single compound or group of compounds is not "predominantly" prepared by a reaction as described herein.

Because of the reversibility of enzymatic reactions, the present invention relates, unless otherwise stated, to the enzymatic or biocatalytic reactions described herein in both directions of reaction.

"Functional mutants" of herein described polypeptides include the "functional equivalents" of such polypeptides as defined below.

The term "stereoisomers" includes in particular conformational isomers.

Included in general are, according to the invention, all "stereoisomeric forms" of the compounds described herein, such as constitutional isomers and, in particular, stereoisomers and mixtures thereof, e.g. optical isomers, or geometric isomers, such as E- and Z-isomers, and combinations thereof. If several asymmetric centers are present in one molecule, the invention encompasses all combinations of different conformations of these asymmetry centers, e.g. enantiomeric pairs "Stereoselectivity" describes the ability to produce a particular stereoisomer of a compound in a stereoisomerically pure form or to specifically convert a particular stereoisomer in an enzyme catalyzed method as described herein out of a plurality of stereoisomers. More specifically, this means that a product of the invention is enriched with respect to a specific stereoisomer, or an educt may be depleted with respect to a particular stereoisomer. This may be quantified via the purity % ee-parameter calculated according to the formula:

$$\% \, ee=[X_A-X_B]/[X_A+X_B]*100,$$

wherein $X_A$ and $X_B$ represent the molar ratio (Molenbruch) of the stereoisomers A and B.

The terms "selectively converting" or "increasing the selectivity" in general means that a particular stereoisomeric form, as for example the E-form, of an unsaturated hydrocarbon, is converted in a higher proportion or amount (compared on a molar basis) than the corresponding other stereoisomeric form, as for example Z-form, either during the entire course of said reaction (i.e. between initiation and termination of the reaction), at a certain point of time of said reaction, or during an "interval" of said reaction. In particular, said selectivity may be observed during an "interval" corresponding 1 to 99%, 2 to 95%, 3 to 90%, 5 to 85%, 10 to 80%, 15 to 75%, 20 to 70%, 25 to 65%, 30 to 60%, or 40 to 50% conversion of the initial amount of the substrate. Said higher proportion or amount may, for example, be expressed in terms of:

- a higher maximum yield of an isomer observed during the entire course of the reaction or said interval thereof;
- a higher relative amount of an isomer at a defined % degree of conversion value of the substrate; and/or
- an identical relative amount of an isomer at a higher % degree of conversion value;

each of which preferably being observed relative to a reference method, said reference method being performed under otherwise identical conditions with known chemical or biochemical means.

Generally also comprised in accordance with the invention are all "isomeric forms" of the compounds described herein, such as constitutional isomers and in particular stereoisomers and mixtures of these, such as, for example, optical isomers or geometric isomers, such as E- and Z-isomers, and combinations of these. If several centers of asymmetry are present in a molecule, then the invention comprises all combinations of different conformations of these centers of asymmetry, such as, for example, pairs of enantiomers, or any mixtures of stereoisomeric forms.

"Yield" and/or the "conversion rate" of a reaction according to the invention is determined over a defined period of, for example, 4, 6, 8, 10, 12, 16, 20, 24, 36 or 48 hours, in which the reaction takes place. In particular, the reaction is carried out under precisely defined conditions, for example at "standard conditions" as herein defined.

The different yield parameters ("Yield" or $Y_{P/S}$; "Specific Productivity Yield"; or Space-Time-Yield (STY)) are well known in the art and are determined as described in the literature.

"Yield" and "$Y_{P/S}$" (each expressed in mass of product produced/mass of material consumed) are herein used as synonyms.

The specific productivity-yield describes the amount of a product that is produced per h and L fermentation broth per g of biomass. The amount of wet cell weight stated as WCW describes the quantity of biologically active microorganism in a biochemical reaction. The value is given as g product per g WCW per h (i.e. $g/gWCW^{-1}\ h^{-1}$). Alternatively, the quantity of biomass can also be expressed as the amount of dry cell weight stated as DCW. Furthermore, the biomass concentration can be more easily determined by measuring the optical density at 600 nm (OD600) and by using an experimentally determined correlation factor for estimating the corresponding wet cell or dry cell weight, respectively.

The term "fermentative production" or "fermentation" refers to the ability of a microorganism (assisted by enzyme activity contained in or generated by said microorganism) to produce a chemical compound in cell culture utilizing at least one carbon source added to the incubation.

The term "fermentation broth" is understood to mean a liquid, particularly aqueous or aqueous/organic solution which is based on a fermentative process and has not been worked up or has been worked up, for example, as described herein.

An "enzymatically catalyzed" or "biocatalytic" method means that said method is performed under the catalytic action of an enzyme, including enzyme mutants, as herein defined. Thus the method can either be performed in the presence of said enzyme in isolated (purified, enriched) or crude form or in the presence of a cellular system, in particular, natural or recombinant microbial cells containing said enzyme in active form, and having the ability to catalyze the conversion reaction as disclosed herein.

If the present disclosure refers to features, parameters and ranges thereof of different degree of preference (including general, not explicitly preferred features, parameters and ranges thereof) then, unless otherwise stated, any combination of two or more of such features, parameters and ranges thereof, irrespective of their respective degree of preference, is encompassed by the disclosure of the present description.

DETAILED DESCRIPTION a. Particular Embodiments of the Invention

The present invention relates to the following particular embodiments:

1. A polypeptide which comprises the enzymatic activity of a lipoxygenase, i.p. of a bifunctional LOX, with an amino acid sequence that comprises a consensus sequence pattern selected from SEQ ID NO:54; or comprises at least one partial consensus sequence pattern of SEQ ID NO:54 selected from

```
                                      (SEQ ID NO: 240)
a) AKxxxxxADxxxxxxxxHxxxxHxxxxPxA,

                                      (SEQ ID NO: 241)
b) VxGxxxxxxxxxxLxxxxxxxxxxxxxxHxxxNxxQxxYxxxxxN,
and

                                      (SEQ ID NO: 242)
c) LxxxxxxIxxxNxxxxxxYxxxxPxxxxxSI;
```

d) or any combination from a), b) and c), and in particular a combination of a), b) and c).
   wherein each amino acid residue x independently of each other may be selected from any natural amino acid residue.

2. The polypeptide of embodiment 1 which comprises the enzymatic activity of a lipoxygenase, i.p. of a bifunctional LOX, with an amino acid sequence that comprises a consensus sequence pattern selected from SEQ ID NO:53; or comprises at least one partial consensus sequence pattern of SEQ ID NO:53 selected from (SEQ ID NO: 243)

a) LxxxxxYxxxxxX$_1$xxxxxxX$_2$GxxxxxxxKxLPxPxxxFxWxxxX$_3$ xxxPxxI

```
                                      (SEQ ID NO: 244)
b) WxxAKxCxQxADxxHxExxxHxxxxHxxMxPxA;

                                      (SEQ ID NO: 245)
c) GxVxGxxxxxxxxxxLxxxxxxxxxxCxPxHxxxNxxQxxYxxxxxN

MPxAxY,

                                      (SEQ ID NO: 246)
d) QxxxxxxLxxxxxDxxGxYxxxX4F,

                                      (SEQ ID NO: 247)
e) QxxLxxxxxxIxxxNxxRxxxxYxxxxxxxxxxNSI,
```

f) or any combination from a) to e), and in particular a combination of b), c) and e), or a) to e),
wherein
each amino acid residue x independently of each other may be selected from any
natural amino acid residue,
$X_1$ represents 0 to 7 identical or different natural amino acid residues,
$X_2$ represents 0 or 1 natural amino acid residue,
$X_3$ represents 0 to 7 identical or different natural amino acid residues, and
$X_4$ represents 0 to 8 identical or different natural amino acid residues.

3. The polypeptide of embodiment 1 which comprises the enzymatic activity of a lipoxygenase, i.p. of a bifunctional LOX, with an amino acid sequence that comprises a consensus sequence pattern selected from SEQ ID NO:52; or comprises at least one partial consensus sequence pattern of SEQ ID NO:52 selected from (SEQ ID NO: 248)

a) LxxxxxYxxxxxX$_1$xxxxxxX$_2$GGxxxxxxxKxLPxPxAxFxWxxxX$_3$ xxxPxxI,

```
                                      (SEQ ID NO: 249)
b) WxxAKxCxQxADxNHxExxxHxxxTHxVMxPxAxxT,

                                      (SEQ ID NO: 250)
c) GxVxGxxxxxxxxxxLxxxxxxxxxxCxPxHxxxNxxQxxYxxxxxN

MPxAxY,
```

(SEQ ID NO: 251)

d) QxxxxxxLxxxxYDxLGxYxxxX$_4$F,

```
                                      (SEQ ID NO: 252)
e) FQxxLxxxxxxIxxxNxxRxxxxYxxxxxPxxxxNSI,
```

g) or any combination from a) to e), and in particular a combination of b), c) and e); or a) to e),
f)
wherein
each amino acid residue x independently of each other may be selected from any natural amino acid residue,
$X_1$ represents 0 to 7 identical or different natural amino acid residues,
$X_2$ represents 0 or 1 natural amino acid residue,
$X_3$ represents 0 to 6 identical or different natural amino acid residues, and
$X_4$ represents 0 to 8 identical or different natural amino acid residues.

The present invention also relates to several groups of polypeptides which comprise the enzymatic activity of a lipoxygenase, i.p. of a bifunctional LOX, and which may not show at least one of the above sequence pattern of embodiments 1, 2 and 3 in an identical manner or which may show a sequence pattern that is similar to at least one of the above pattern but does not completely match therewith.

4. Thus another embodiment of the invention refers to a polypeptide which comprises the enzymatic activity of a lipoxygenase, i.p. of a bifunctional LOX, optionally fulfilling any one of the preceding embodiments, and comprising an amino acid sequence selected from
   a) SEQ ID NO: 3, 6, 9, 12 or 15;
   b) SEQ ID NO: 18
   c) SEQ ID NO: 20, 22, 24, 26, 28, 30, 32, 34, 36, 38, 40, 42, 44, 46, 48, or 50 and
   d) amino acid sequences having at least 40% sequence identity to at least one of the sequences of a), b) or c) and retaining said enzymatic activity of a lipoxygenase.

Thus, the polypeptides of the present embodiment may or may not meet the limitations of anyone of the embodiments 1, 2 and 3.

A first particular group of polypeptides comprises an amino acid sequence selected from SEQ ID NO: 3, 6, 9, 12 or 15; (CoLOXs) and amino acid sequences having at least 40%, 45%, 50%, 55%, 60%, 65%, 70%, 75%, 80%, 85%, 90%, 95%, 96%, 97%, 98%, or 99% sequence identity to at least one of these sequences and retaining said bifunctional LOX activity, and which may not meet the limitations of anyone of the embodiments 1, 2 and 3;

or alternatively selected from:

SEQ ID NO: 3, 6, 9, 12 or 15; (CoLOXs) and amino acid sequences having at least 40%, 45%, 50%, 55%, 60%, 65%, 70%, 75%, 80%, 85%, 90%, 95%, 96%, 97%, 98%, or 99% sequence identity to at least one of these sequences and retaining said bifunctional LOX activity, and which meet the limitations of anyone of the embodiments 1, 2 and 3.

A second particular group of polypeptides comprises an amino acid sequence selected from SEQ ID NO: 18 (UfLOX2) and amino acid sequences having at least 40%, 45%, 50%, 55%, 60%, 65%, 70%, 75%, 80%, 85%, 90%, 95%, 96%, 97%, 98%, or 99% sequence identity thereto and retaining said bifunctional LOX activity and which may not meet the limitations of anyone of the embodiments 1, 2 and 3; or alternatively selected from:

SEQ ID NO: 18 (UfLOX2) and amino acid sequences having at least 40%, 45%, 50%, 55%, 60%, 65%, 70%, 75%, 80%, 85%, 90%, 95%, 96%, 97%, 98%, or 99% sequence identity thereto and retaining said bifunctional LOX activity and which meet the limitations of anyone of the embodiments 1, 2 and 3;

A third particular group of polypeptides comprises an amino acid sequence selected from SEQ ID NO: 20, 22, 24, 26, 28, 30, 32, 34, 36, 38, 40, 42, 44, 46, 48, or 50 (bacterial LOXs) and amino acid sequences having at least 40%, 45%, 50%, 55%, 60%, 65%, 70%, 75%, 80%, 85%, 90%, 95%, 96%, 97%, 98%, or 99% sequence identity to at least one of these sequences and retaining said bifunctional LOX activity, and which may not meet the limitations of anyone of the embodiments 1, 2 and 3; or alternatively selected from:

SEQ ID NO: 20, 22, 24, 26, 28, 30, 32, 34, 36, 38, 40, 42, 44, 46, 48, or 50 (bacterial LOXs) and amino acid sequences having at least 40%, 45%, 50%, 55%, 60%, 65%, 70%, 75%, 80%, 85%, 90%, 95%, 96%, 97%, 98%, or 99% sequence identity to at least one of these sequences and retaining said bifunctional LOX activity, and which meet the limitations of anyone of the embodiments 1, 2 and 3.

A particular subgroup of said third group of polypeptides relates to SEQ ID NO: 20 and 26 and amino acid sequences having at least 40%, 45%, 50%, 55%, 60%, 65%, 70%, 75%, 80%, 85%, 90%, 95%, 96%, 97%, 98%, or 99% sequence identity to at least one of these sequences and retaining said bifunctional LOX activity.

5. A polypeptide which comprises the enzymatic activity of a lipoxygenase with an amino acid sequence that is selected from SEQ ID NO: 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230232, 234, 236, 238 or 239; and amino acid sequences having at least 40% sequence identity to at least one of said sequences and retaining said enzymatic activity of a lipoxygenase.

A fourth particular group of polypeptides comprising an amino acid sequence selected from SEQ ID NO: 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230232, 234, 236, 238 and 239 and amino acid sequences having at least 40%, 45%, 50%, 55%, 60%, 65%, 70%, 75%, 80%, 85%, 90%, 95%, 96%, 97%, 98%, or 99% sequence identity to at least one of said sequences and retaining said bifunctional LOX activity.

6. A polypeptide as defined in anyone of the preceding embodiment having, preferably bifunctional, LOX activity and mutants thereof.

Particular examples of suitable mutants of UfLOX 2 (SEQ ID NO:18) are:

- Mutants of SEQ ID NO:18 wherein one or more, as for example 1 to 50, 1 to 40, 1 to 30, 1 to 20, 1 to 10, like 1, 2, 3, 4, 5, 6, 7, 8 or 9 amino acid mutations are performed (generating a mutation profile) in a sequence position different from potential key positions such as C7, D134, R136, C161, A219, S256, C278, S305, C409 and G526 of SEQ ID NO:18, and which mutation(s) provide a bifunctional LOX mutant with a feature profile, such as unsaturated $C_{10}$-aldehyde productivity, unsaturated $C_{10}$-aldehyde product profile, substrate profile, side product profile or combinations thereof, which is substantially identical if compared to the non-mutated parent enzyme; as well as further mutants derived from such a mutant, having a degree of sequence identity of least 40%, 45%, 50%, 55%, 60%, 65%, 70%, 75%, 80%, 85%, 90%, 95%, 96%, 97%, 98%, or 99% to SEQ ID NO:18, retaining said mutation profile and preferably still showing a feature profile substantially identical to the non-mutated enzyme. In particular, such single or multiple mutants may be obtained by performing so-called conservative mutations, as for example conservative amino acid substitutions as explained defined herein below.
- Mutants of SEQ ID NO:18 wherein one or more, as for example 1 to 10, like 1, 2, 3, 4, 5, 6, 7, 8 or 9 amino acid mutations are performed (generating another mutation profile) in a potential key sequence position selected from C7, D134, R136, C161, A219, S256, C278, S305, C409 and G526 of SEQ ID NO:18, and which mutation(s) provide a bifunctional LOX mutant with a, if compared to the non-mutated parent enzyme, different profile of features, like for example improved unsaturated $C_{10}$-aldehyde productivity, different unsaturated $C_{10}$-aldehyde product profile, different PUFA substrate profile, production of less side products or combinations thereof; as well as further mutants derived there form, having a degree of sequence identity of least 40%, 45%, 50%, 55%, 60%, 65%, 70%, 75%, 80%, 85%, 90%, 95%, 96%, 97%, 98%, or 99% to SEQ ID NO:18, and retaining said mutation profile in said key positions and preferably still showing said modified functional profile. In particular such single or multiple mutants in key positions may be obtained by performing so-called non-conservative mutations.

Based on the sequence alignments provided herein (see FIGS. 11, 14, 15, 16 and 17) the results of mutational experiments performed with one particular LOX (like UfLOX2) may be transferred in analogy to the corresponding amino acid residue position of another LOX enzyme as described herein in order evaluate the respective mutation in said other enzyme and in order to obtain further suitable bifunctional LOX enzymes suitable for preparing at least one unsaturated $C_{10}$-aldehyde from at least one PUFA substrate.

Particular examples of suitable mutants of bacterial LOX are:

Single and multiple mutants of anyone of the polypeptides of SEQ ID NO: 20, 22, 24, 26, 28, 30, 32, 34, 36, 38, 40, 42, 44, 46, 48, or 50, which mutants retain said enzymatic activity of a lipoxygenase, i.p. bifunctional LOX, which mutants are in particular selected from mutants comprising an amino acid sequence selected from SEQ ID NO: 254, 256, 258, 260, 262, 264, 266, 268, 270, 272, 274, 276, 278, 280, 282, 284, 286, 288 and 290; or encoded by a nucleotide sequences encoding a polypeptide retaining said enzymatic activity of a lipoxygenase, in particular selected from SEQ ID NO: 253, 255, 257, 259, 261, 263, 265, 267, 269, 271, 273, 275, 277, 279, 281, 283, 285, 287 and 289.

Such bifunctional LOX mutants may show, if compared to the non-mutated parent enzyme, a different profile of features, like for example improved unsaturated $C_{10}$-aldehyde productivity, different unsaturated $C_{10}$-aldehyde product profile, different PUFA substrate profile, production of less side products, or combinations thereof;

Provided are also mutants derived from SEQ ID NO: 254, 256, 258, 260, 262, 264, 266, 268, 270, 272, 274, 276, 278, 280, 282, 284, 286, 288 and 290, and having a degree of sequence identity of least 40%, 45%, 50%, 55%, 60%, 65%, 70%, 75%, 80%, 85%, 90%, 95%, 96%, 97%, 98%, or 99% to the respective native bacterial LOX amino acid sequence, while retaining said mutation profile in said key positions and preferably still showing said modified functional profile. In particular, such single or multiple mutants in key positions may be obtained by performing so-called conservative mutations.

A person of ordinary skill will be able to generate, based on the disclosed particular mutants, such further function mutants. For example, conservative amino acid substitutions in one or more of the mutation positions listed in the subsequent Table may be performed in this respect.

7. The polypeptide of anyone of the embodiments 1 to 6 having the enzymatic activity of a bifunctional LOX and in particular of a combination of LOX and HPL activity.

8. The polypeptide of anyone of the embodiments 1 to 7, comprising the ability of converting at least one polyunsaturated fatty acid (PUFA), in particular selected from omega-3 and omega-6 PUFA, to at least one mono- or polyunsaturated aliphatic aldehyde.

9. The polypeptide of embodiment 8, comprising the ability to convert at least one PUFA to at least one polyunsaturated aliphatic $C_{10}$-aldeyde.

10. The polypeptide of embodiment 9, comprising the ability to convert at least one PUFA to at least one polyunsaturated aliphatic $C_{10}$-aldeyde, selected from decadienals and decatrienals, each either in essentially pure stereoisomeric form or in the form of a mixture of at least two stereoisomers, preferably selected from 2E,4Z-decadienal, 2E,4E-decadienal, 2E,4Z,7Z-decatrienal, 2E,4E,7Z-decatrienal and mixtures thereof.

11. The polypeptide of any one of the embodiments 7 to 10, wherein said PUFA is selected from $C_{16}$-$C_{22}$—, in particular from $C_{16}$-$C_{20}$-PUFAs, more particularly selected from omega-3 $C_{16}$-$C_{20}$-PUFAs and omega-6 $C_{16}$-$C_{20}$-PUFAs.

12. The polypeptide of embodiment 11, wherein said PUFA is selected from a) the $C_{16}$-PUFA hexadecatrienoic acid (HTA),
b) the $C_{18}$-PUFAs linoleic acid (LA), alpha linolenic acid (ALA) and gamma-linolenic acid (GLA), stearidonic acid (SDA);
c) the $C_{20}$-PUFAs arachidonic acid (ARA) and eicosapentaenoic acid (EPA)
d) the $C_{22}$-PUFA docosahexaenoic acid (DHA)

13. A nucleic acid encoding the polypeptide of any one of embodiments 1 to 12 or the complement thereof.

14. The nucleic acid of embodiment 13, comprising a coding nucleotide selected from a) SEQ ID NO: 1, 2, 4, 5, 7, 8, 10, 11, 13 and 14 (CoLOX sequences);
b) SEQ ID NO: 16 and 17 (UfLOX2 sequences);
c) Codon optimized coding sequences according to SEQ ID NO: 19, 21, 23, 25, 27, 29, 31, 33, 35, 37, 39, 41, 43, 45, 47, 49, and natural coding sequences according to SEQ ID NO: 59, 60, 61, 62, 63, 64, 65, 66, 67, 68, 69, 70, 71, 72, 73 and 74;

| SEQ ID NOs | Gene ID | Amino acid mutations |
|---|---|---|
| 254 | WP_002738122.1mut | A167C, G273C, H300S, L404C |
| 256 | WP_002738122.1mut2 | N156E, A167C, S180C, L181M, G273C, L404C |
| 258 | WP_015204462.1mut | Y5C, P129A, T162C, G277C, H304S, L408C |
| 260 | WP_015204462.1mut2 | Y5C, T162C, G255S, G277C, H304S, L408C, N584G |
| 262 | WP_015204462.1mut3 | Y5C, P129A, R151E, T162C, K208Q, A218P, G255A, G277C, H304S, L408C |
| 264 | WP_006635899.1mut | L8C, S132A, A161C, V267C, D294S, L398C |
| 266 | WP_015178512.1mut | S8C, P132A, A161C, V267C, E294S, L398C |
| 268 | WP_028091425.1mut | F4C, P127D, N129R, A159C, V260C, D287S, L391C |
| 270 | OBQ01436.1mut | F4C, P127D, N129R, A159C, V260C, D287S, L391C |
| 272 | OBQ25779.1mut | F8C, P131D, N133R, A163C, V264C, D291S, L395C |
| 274 | WP_039200563.1mut | F4C, P127D, N129R, A159C, V260C, D287S, L391C |
| 276 | WP_012407347.1mut | Y4C, P127D, D128A, G129R, A159C, V260C, D287S, L391C |
| 278 | WP_027843955.1mut | Y4C, P128D, P129A, H130R, A160C, V261C, E288S, L397C |
| 280 | WP_073641301.1mut | Y4C, P127D, L128A, G129R, T159C, V260C, D287S, L391C |
| 282 | WP_096647440.1mut | Y4C, P127D, D128A, G129R, A159C, V260C, E287S, L391C |
| 284 | WP_099099431.1mut | Y4C, P127D, D128A, N129R, L159C, V260C, D287S, L391C |
| 286 | WP_052672367.1mut | Y4C, P127D, E128A, N129R, L159C, I260C, E287S, L390C |
| 288 | WP_073631249.1mut | Y4C, P127D, E128A, K129R, L159C, V260C, D287S, L391C |
| 290 | WP_013220336.1mut | S4C, P127D, E128A, D129R, L159C, E160D, F161Y, V253C, D280S, L384C |

Non-limiting examples of possible conservative amino acid residue substitutions are provided in the subsequent section of the description.

d) nucleotide sequences encoding a single and multiple mutants of anyone of the sequences c) encoding a polypeptide retaining said enzymatic activity of a lipoxygenase, in particular selected from SEQ ID NO: 253, 255, 257, 259, 261, 263, 265, 267, 269, 271, 273, 275, 277, 279, 281, 283, 285, 287 and 289;

e) SEQ ID NO: 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235 and 237;

f) a sequence having at least 40%, 45%, 50%, 55%, 60%, 65%, 70%, 75%, 80%, 85%, 90%, 95%, 96%, 97%, 98%, or 99% sequence identity to at least one of the sequences of a) b) c, or d); or g) the complement of anyone of the sequences of a), b), c), d), e) and f).

15. An expression vector comprising the coding nucleic acid of any one of embodiments 13 and 14.

16. The expression vector of embodiment 15, in the form of a viral vector, a bacteriophage or a plasmid.

17. The expression vector of embodiment 15 or 16, wherein the coding nucleic acid is linked to at least one regulatory sequence and, optionally, including at least one selection marker.

18. A recombinant non-human host organism or cell harboring at least one nucleic acid according to any one of embodiments 13 and 14 or harboring at least one expression vector of one of the embodiments 15 to 17.

19. The non-human host organism of embodiment 18, wherein said non-human host organism is an eukaryote or a prokaryote, in particular a plant, a bacterium or a fungus, more particular a bacterium or yeast.

20. The non-human host organism of embodiment 19, wherein said bacterium is of the genus *Escherichia* or *Bacillus*, in particular *E. coli* and said yeast is of the genus *Saccharomyces, Yarrowia* or *Pichia*, in particular *S. cerevisiae, Y. lipolytica* or *P. pastoris.*

21. The non-human host cell of embodiment 20, which is a plant cell, algae or seaweed.

22. A method for producing at least one polypeptide according to any one of embodiments 1 to 12 comprising:

a) culturing a non-human host organism or cell harboring at least one nucleic acid according to any one of embodiments 13 and 14 and expressing or over-expressing at least one polypeptide according to any one of embodiments 1 to 12;

b) optionally isolating said polypeptide from the non-human host organism or cell cultured in step a).

23. The method of embodiment 22, further comprising, prior to step a), providing a non-human host organism or cell with at least one nucleic acid according to any one of embodiments 13 or 14 so that it expresses or over-expresses the polypeptide according to any one of embodiments 1 to 12.

24. A method for preparing a mutant polypeptide capable of converting at least one polyunsaturated fatty acid (PUFA), in particular omega-3 or omega-6 PUFA, to at least one mono- or polyunsaturated aliphatic aldehyde, comprising the steps of:

a) selecting a nucleic acid according to any one of embodiments 13 and 14;

b) modifying the selected nucleic acid to obtain at least one mutant nucleic acid;

c) providing host cells or unicellular organisms with the mutant nucleic acid sequence to express a polypeptide encoded by the mutant nucleic acid sequence;

d) screening for at least one mutant polypeptide with activity in converting at least one polyunsaturated fatty acid (PUFA), in particular omega-3 of omega-6 PUFA, to at least one mono- or polyunsaturated aliphatic aldehyde;

e) optionally, if the mutated polypeptide has no desired activity, repeating the process steps a) to d) until a polypeptide with a desired activity is obtained; and, f) optionally, if a mutant polypeptide having a desired activity was identified in step d) or e), isolating the corresponding mutant nucleic acid.

25. A method for preparing an at least one mono- or polyunsaturated aliphatic aldehyde, which method comprises a) contacting at least one PUFA substrate with a polypeptide as defined in anyone of the embodiments 1 to 12, or encoded by a nucleic acid as defined in anyone of the embodiments 13 and 14, thereby converting said at least one PUFA compound to a reaction product comprising at least one mono- or polyunsaturated aliphatic aldehyde; and b) optionally isolating least one mono- or polyunsaturated aliphatic aldehyde as obtained in step a).

26. The method of embodiment 25, wherein step a) is performed in vivo in cell culture in the presence of oxygen, or in vitro in a liquid reaction medium in the presence of oxygen.

If performed in vivo, said method comprises prior to step a) introducing into a non-human host organism or cell and optionally stably integrated into the respective genome; one or more nucleic acid molecules encoding one or more polypeptides having the enzyme activities required for performing the respective biocatalytic conversion step or steps.

27. The method of any one of embodiments 25 and 26, wherein step a) is carried out by cultivating a non-human host organism or cell expressing at least one of said polypeptides having the enzymatic activity of a preferably bifunctional LOX in the presence of a PUFA substrate under conditions conducive to the peroxidation and subsequent cleavage of at least one PUFA.

28. The method of embodiment 25, wherein said at least one mono- or polyunsaturated aliphatic aldehyde is selected from decadienals and decatrienals.

29. The method of embodiment 28, wherein said decadienal is selected from 2E,4E-decadienal and 2E,4Z-decadienal and mixtures thereof; and wherein said decatrienal is selected from 2E,4E, 7Z-decatrienal and 2E,4Z,7Z-decatrienal and mixtures thereof.

30. The method of one of the embodiments 25 to 29, wherein said PUFA substrate is an isolated, essentially pure PUFA compound or a natural or synthetic composition comprising at least one PUFA convertible by said preferably bifunctional LOX.

31. The method of embodiment 30, wherein said natural PUFA composition is selected from a) borage oil (containing elevated proportions of GLA), b) arachidonic oil (containing elevated proportions of ARA), c) fish oil (containing elevated proportions of EPA), d) linseed oil e) echium oil f) corresponding oil hydrolysates of a) to e);

g) mixtures of LA and ALA; and h) mixtures containing at least two of a) to g).

32. The method of embodiment 30 or 31, wherein a preferably bifunctional LOX comprising an amino acid sequence of SEQ ID NO: 3, 6, 9, 12 or 15; (CoLOX) or a sequence having at least 40%, 45%, 50%, 55%, 60%, 65%, 70%, 75%, 80%, 85%, 90%, 95%, 96%, 97%, 98%, or 99% sequence identity thereto is applied and the substrate is selected from h) borage oil (containing elevated proportions of GLA) in order to produce as main product 2E,4Z-decadienal and/or 2E,4E-decadienal i) evening primrose oil (containing elevated proportions of GLA) in order to produce as main product 2E,4Z-decadienal and/or 2E,4E-decadienal j) Arachidonic oil (containing elevated proportions of ARA) in order to produce as main product 2E,4Z-decadienal and/or 2E,4E-decadienal k) echium seed oil (containing elevated proportions of SDA) in order to produce as main product 2E,4Z, 7Z-decatrienal and/or 2E,4E,7Z-decatrienal l) fish oil (containing elevated proportions of EPA)) in order to produce as mains product 2E,4Z, 7Z-decatrienal and/or 2E,4E,7Z-decatrienal m) linseed oil (containing elevated proportions of ALA)) in order to produce as main product 2E,4Z, 7Z-decatrienal and/or 2E,4E,7Z-decatrienal n) micro algae oil (containing elevated proportions of DHA) in order to produce as main product 2E,4Z-decadienal, 2E,4E-decadienal 2E,4Z, 7Z-decatrienal and/or 2E,4E,7Z-decatrienal o) LA in order to produce as main product 2E,4Z-decadienal and/or 2E,4E-decadienal p) GLA in order to produce as main product 2E,4Z-decadienal and/or 2E,4E-decadienal q) ARA in order to produce as main product 2E,4Z-decadienal and/or 2E,4E-decadienal r) EPA in order to produce as main product 2E,4Z, 7Z-decatrienal and/or 2E,4E,7Z-decatrienal 33. The method of embodiment 30 or 31, wherein a preferably bifunctional LOX comprising an amino acid sequence of SEQ ID NO:18 (UfLOX2) or a sequence having at least 40%, 45%, 50%, 55%, 60%, 65%, 70%, 75%, 80%, 85%, 90%, 95%, 96%, 97%, 98%, or 99% sequence identity thereto is applied and the substrate is selected from a) borage oil (containing elevated proportions of GLA) in order to produce as main product 2E,4Z-decadienal and/or 2E,4E-decadienal b) evening primrose oil (containing elevated proportions of GLA) in order to produce as main product 2E,4Z-decadienal and 2E,4E-decadienal c) arachidonic oil (containing elevated proportions of ARA)) in order to produce as mains product 2E,4Z-decadienal and 2E,4E-decadienal d) echium seed oil (containing elevated proportions of SDA) in order to produce as main product 2E,4Z, 7Z-decatrienal and 2E,4E,7Z-decatrienal e) fish oil (containing elevated proportions of EPA)) in order to produce as main product 2E,4Z, 7Z-decatrienal and 2E,4E,7Z-decatrienal f) linseed oil (containing elevated proportions of ALA)) in order to produce as main product 2E,4Z, 7Z-decatrienal and 2E,4E,7Z-decatrienal g) micro algae oil (containing elevated proportions of DHA oil in step a) to e)) in order to produce as mains product 2E,4Z-decadienal, 2E,4E-decadienal 2E,4Z, 7Z-decatrienal and 2E,4E,7Z-decatrienal, h) LA in order to produce as main product 2E,4Z-decadienal and/or 2E,4E-decadienal i) GLA in order to produce as main product 2E,4Z-decadienal and/or 2E,4E-decadienal j) ARA in order to produce as main product 2E,4Z-decadienal and/or 2E,4E-decadienal k) EPA in order to produce as main product 2E,4Z, 7Z-decatrienal and/or 2E,4E,7Z-decatrienal 34. The method of any one of the embodiments 25 to 31 or 33 wherein a crude or partially purified homogenate of *Ulva fasciata* containing said preferably bifunctional LOX activity is applied.

35. The method of embodiment 30 or 31, wherein a preferably bifunctional LOX comprising an amino acid sequence of SEQ ID NO: 20. 22, 24, 26, 28, 30, 32, 34, 36, 38, 40, 42, 44, 46, 48, or 50 (bacterial LOXs) or a sequence having at least 40%, 45%, 50%, 55%, 60%, 65%, 70%, 75%, 80%, 85%, 90%, 95%, 96%, 97%, 98%, or 99% sequence identity thereto is applied and the substrate is selected from:

a) GLA in order to produce as main product 2E,4Z-decadienal and/or 2E,4E-decadienal and b) ARA in order to produce as main product 2E,4Z-decadienal and/or 2E,4E-decadienal.

36. The method of embodiments 25 to 35, further comprises a chemical or enzymatic isomerization of an obtained mono- or polyunsaturated aliphatic aldehyde; or a chemical or enzymatic conversion of an obtained mono- or polyunsaturated aliphatic aldehyde to the corresponding alcohol or hydrocarbyl ester.

37. The method of anyone of the embodiments 25 to 36, wherein the conversion of said PUFA substrate is performed in a liquid reaction medium supplemented with at least one cofactor, selected from metal salts soluble in said liquid reaction medium, like in particular di- or polyvalent metal salts. Particular salts are halide salts like chloride, bromide or fluoride salts. As example of metal ions may be mentioned, di- or polyvalent metal cations or alkaline earth metal cations, more particularly di- or polyvalent cations derived from Mg, Mn and Fe, like $Mg^{2+}$, $Mn^{2+}$ and $Fe^{2+}$ or $Fe^{3+}$.

Optionally said method of anyone of the preceding embodiments further comprises the processing of the obtained aldehyde to a corresponding derivative using chemical or biocatalytic synthesis or a combination of both. For example, such derivative may be selected from a hydrocarbon, an alcohol, diol, triol, acetal, ketal, acid, ether, amide, ketone, lactone, epoxide, acetate, glycoside and/or an ester.

38. A combination of at least two unsaturated $C_{10}$-aldehyde isomers, selected from 2E,4Z-decadienal, 2E,4E-decadienal, 2E,4Z,7Z-decatrienal and 2E,4E, 7Z-decatrienal, wherein a particular ratio between 2E,4E-decadienal and 2E,4Z-decadienal is from 3:1 to 1:9 and a particular ratio between 2E,4Z,7Z-decatrienal and 2E,4E, 7Z-decatrienal is from 3:1 to 1:9.

39. The use of a mono- or polyunsaturated aliphatic aldehyde or of a mixture of at least two of such aldehydes, and/or of corresponding conversion products and mixtures thereof as obtained by a method of anyone of the embodiments 25 to 37 or of an isomer combination of embodiment 38 as flavour ingredient for the manufacture of food or feed compositions.

40. A food or feed composition supplemented by at least one flavour ingredient as defined in embodiment 39.

41. The use of a polypeptide which comprises the enzymatic activity of a lipoxygenase as defined in anyone of the claims 1 to 12 or encoded by an nucleotide sequence as defined in anyone of the claims 13 and 14 for preparing an at least one mono- or polyunsaturated aliphatic aldehyde, in particular by a method as defined in anyone of the claims 25 to 37.

b. Polypeptides Applicable According to the Invention

In this context the following definitions apply:

The generic terms "polypeptide" or "peptide", which may be used interchangeably, refer to a natural or synthetic linear chain or sequence of consecutive, peptidically linked amino acid residues, comprising about 10 to up to more than 1.000 residues. Short chain polypeptides with up to 30 residues are also designated as "oligopeptides".

The term "protein" refers to a macromolecular structure consisting of one or more polypeptides. The amino acid sequence of its polypeptide(s) represents the "primary structure" of the protein. The amino acid sequence also predetermines the "secondary structure" of the protein by the formation of special structural elements, such as alpha-helical and beta-sheet structures formed within a polypeptide chain. The arrangement of a plurality of such secondary structural elements defines the "tertiary structure" or spatial arrangement of the protein. If a protein comprises more than one polypeptide chains said chains are spatially arranged forming the "quaternary structure" of the protein. A correct spacial arrangement or "folding" of the protein is prerequisite of protein function. Denaturation or unfolding destroys protein function. If such destruction is reversible, protein function may be restored by refolding.

A typical protein function referred to herein is an "enzyme function", i.e. the protein acts as biocatalyst on a substrate, for example a chemical compound, and catalyzes the conversion of said substrate to a product. An enzyme may show a high or low degree of substrate and/or product specificity.

A "polypeptide" referred to herein as having a particular "activity" thus implicitly refers to a correctly folded protein showing the indicated activity, as for example a specific enzyme activity.

Thus, unless otherwise indicated the term "polypeptide" also encompasses the terms "protein" and "enzyme".

Similarly, the term "polypeptide fragment" encompasses the terms "protein fragment" and "enzyme fragment".

The term "isolated polypeptide" refers to an amino acid sequence that is removed from its natural environment by any method or combination of methods known in the art and includes recombinant, biochemical and synthetic methods.

"Target peptide" refers to an amino acid sequence which targets a protein, or polypeptide to intracellular organelles, i.e., mitochondria, or plastids, or to the extracellular space (secretion signal peptide). A nucleic acid sequence encoding a target peptide may be fused to the nucleic acid sequence encoding the amino terminal end, e.g., N-terminal end, of the protein or polypeptide, or may be used to replace a native targeting polypeptide.

The present invention also relates to "functional equivalents" (also designated as "analogs" or "functional mutations") of the polypeptides specifically described herein.

For example, "functional equivalents" refer to polypeptides which, in a test used for determining enzymatic LOX activity display at least a 1 to 10%, or at least 20%, or at least 50%, or at least 75%, or at least 90% higher or lower activity, as that of the polypeptides specifically described herein.

"Functional equivalents", according to the invention, also cover particular mutants, which, in at least one sequence position of an amino acid sequences stated herein, have an amino acid that is different from that concretely stated one, but nevertheless possess one of the aforementioned biological activities, as for example enzyme activity. "Functional equivalents" thus comprise mutants obtainable by one or more, like 1 to 20, in particular 1 to 15 or 5 to 10 amino acid additions, substitutions, in particular conservative substitutions, deletions and/or inversions, where the stated changes can occur in any sequence position, provided they lead to a mutant with the profile of properties according to the invention. Functional equivalence is in particular also provided if the activity patterns coincide qualitatively between the mutant and the unchanged polypeptide, i.e. if, for example, interaction with the same agonist or antagonist or substrate, however at a different rate, (i.e. expressed by a $EC_{50}$ or $IC_{50}$ value or any other parameter suitable in the present technical field) is observed. Examples of suitable (conservative) amino acid substitutions are shown in the following table:

| Original residue | Examples of substitution |
|---|---|
| Ala | Ser |
| Arg | Lys |
| Asn | Gln; His |
| Asp | Glu |
| Cys | Ser |
| Gln | Asn |
| Glu | Asp |
| Gly | Pro |
| His | Asn; Gln |
| Ile | Leu; Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

"Functional equivalents" in the above sense are also "precursors" of the polypeptides described herein, as well as "functional derivatives" and "salts" of the polypeptides.

"Precursors" are in that case natural or synthetic precursors of the polypeptides with or without the desired biological activity.

The expression "salts" means salts of carboxyl groups as well as salts of acid addition of amino groups of the protein molecules according to the invention. Salts of carboxyl groups can be produced in a known way and comprise inorganic salts, for example sodium, calcium, ammonium, iron and zinc salts, and salts with organic bases, for example amines, such as triethanolamine, arginine, lysine, piperidine and the like. Salts of acid addition, for example salts with inorganic acids, such as hydrochloric acid or sulfuric acid and salts with organic acids, such as acetic acid and oxalic acid, are also covered by the invention.

"Functional derivatives" of polypeptides according to the invention can also be produced on functional amino acid side groups or at their N-terminal or C-terminal end using known techniques. Such derivatives comprise for example aliphatic esters of carboxylic acid groups, amides of carboxylic acid groups, obtainable by reaction with ammonia or with a primary or secondary amine; N-acyl derivatives of free amino groups, produced by reaction with acyl groups; or O-acyl derivatives of free hydroxyl groups, produced by reaction with acyl groups.

"Functional equivalents" naturally also comprise polypeptides that can be obtained from other organisms, as well as naturally occurring variants. For example, areas of homologous sequence regions can be established by sequence comparison, and equivalent polypeptides can be determined on the basis of the concrete parameters of the invention.

"Functional equivalents" also comprise "fragments", like individual domains or sequence motifs, of the polypeptides according to the invention, or N- and or C-terminally truncated forms, which may or may not display the desired biological function. Preferably such "fragments" retain the desired biological function at least qualitatively.

"Functional equivalents" are, moreover, fusion proteins, which have one of the polypeptide sequences stated herein or functional equivalents derived there from and at least one further, functionally different, heterologous sequence in functional N-terminal or C-terminal association (i.e. without substantial mutual functional impairment of the fusion protein parts). Non-limiting examples of these heterologous sequences are e.g. signal peptides, histidine anchors or enzymes.

"Functional equivalents" which are also comprised in accordance with the invention are homologs to the specifically disclosed polypeptides. These have at least 60%, preferably at least 75%, in particular at least 80 or 85%, such as, for example, 90, 91, 92, 93, 94, 95, 96, 97, 98 or 99%, homology (or identity) to one of the specifically disclosed amino acid sequences, calculated by the algorithm of Pearson and Lipman, Proc. Natl. Acad, Sci. (USA) 85(8), 1988, 2444-2448. A homology or identity, expressed as a percentage, of a homologous polypeptide according to the invention means in particular an identity, expressed as a percentage, of the amino acid residues based on the total length of one of the amino acid sequences described specifically herein.

The identity data, expressed as a percentage, may also be determined with the aid of BLAST alignments, algorithm blastp (protein-protein BLAST), or by applying the Clustal settings specified herein below.

In the case of a possible protein glycosylation, "functional equivalents" according to the invention comprise polypeptides as described herein in deglycosylated or glycosylated form as well as modified forms that can be obtained by altering the glycosylation pattern.

Functional equivalents or homologues of the polypeptides according to the invention can be produced by mutagenesis, e.g. by point mutation, lengthening or shortening of the protein or as described in more detail below.

Functional equivalents or homologs of the polypeptides according to the invention can be identified by screening combinatorial databases of mutants, for example shortening mutants. For example, a variegated database of protein variants can be produced by combinatorial mutagenesis at the nucleic acid level, e.g. by enzymatic ligation of a mixture of synthetic oligonucleotides. There are a great many methods that can be used for the production of databases of potential homologues from a degenerated oligonucleotide sequence. Chemical synthesis of a degenerated gene sequence can be carried out in an automatic DNA synthesizer, and the synthetic gene can then be ligated in a suitable expression vector. The use of a degenerated genome makes it possible to supply all sequences in a mixture, which code for the desired set of potential protein sequences. Methods of synthesis of degenerated oligonucleotides are known to a person skilled in the art.

In the prior art, several techniques are known for the screening of gene products of combinatorial databases, which were produced by point mutations or shortening, and for the screening of cDNA libraries for gene products with a selected property. These techniques can be adapted for the rapid screening of the gene banks that were produced by combinatorial mutagenesis of homologues according to the invention. The techniques most frequently used for the screening of large gene banks, which are based on a high-throughput analysis, comprise cloning of the gene bank in expression vectors that can be replicated, transformation of the suitable cells with the resultant vector database and expression of the combinatorial genes in conditions in which detection of the desired activity facilitates isolation of the vector that codes for the gene whose product was detected. Recursive Ensemble Mutagenesis (REM), a technique that increases the frequency of functional mutants in the databases, can be used in combination with the screening tests, in order to identify homologues.

An embodiment provided herein provides orthologs and paralogs of polypeptides disclosed herein as well as methods for identifying and isolating such orthologs and paralogs. A definition of the terms "ortholog" and "paralog" is given below and applies to amino acid and nucleic acid sequences.

c. Coding Nucleic Acid Sequences Applicable According to the Invention

In this context the following definitions apply:

The terms "nucleic acid sequence," "nucleic acid," "nucleic acid molecule" and "polynucleotide" are used interchangeably meaning a sequence of nucleotides. A nucleic acid sequence may be a single-stranded or double-stranded deoxyribonucleotide, or ribonucleotide of any length, and include coding and non-coding sequences of a gene, exons, introns, sense and anti-sense complimentary sequences, genomic DNA, cDNA, miRNA, siRNA, mRNA, rRNA, tRNA, recombinant nucleic acid sequences, isolated and purified naturally occurring DNA and/or RNA sequences, synthetic DNA and RNA sequences, fragments, primers and nucleic acid probes. The skilled artisan is aware that the nucleic acid sequences of RNA are identical to the DNA sequences with the difference of thymine (T) being replaced by uracil (U). The term "nucleotide sequence" should also be understood as comprising a polynucleotide molecule or an oligonucleotide molecule in the form of a separate fragment or as a component of a larger nucleic acid.

An "isolated nucleic acid" or "isolated nucleic acid sequence" relates to a nucleic acid or nucleic acid sequence that is in an environment different from that in which the nucleic acid or nucleic acid sequence naturally occurs and can include those that are substantially free from contaminating endogenous material.

The term "naturally-occurring" as used herein as applied to a nucleic acid refers to a nucleic acid that is found in a cell of an organism in nature and which has not been intentionally modified by a human in the laboratory.

A "fragment" of a polynucleotide or nucleic acid sequence refers to contiguous nucleotides that are particularly at least 15 bp, at least 30 bp, at least 40 bp, at least 50 bp and/or at least 60 bp in length of the polynucleotide of an embodiment herein. Particularly the fragment of a polynucleotide comprises at least 25, more particularly at least 50, more particularly at least 75, more particularly at least 100, more particularly at least 150, more particularly at least 200, more particularly at least 300, more particularly at least 400, more particularly at least 500, more particularly at least 600, more particularly at least 700, more particularly at least 800, more particularly at least 900, more particularly at least 1000 contiguous nucleotides of the polynucleotide of an embodiment herein. Without being limited, the fragment of the polynucleotides herein may be used as a PCR primer, and/or as a probe, or for anti-sense gene silencing or RNAi.

As used herein, the term "hybridization" or hybridizes under certain conditions is intended to describe conditions for hybridization and washes under which nucleotide sequences that are significantly identical or homologous to each other remain bound to each other. The conditions may be such that sequences, which are at least about 70%, such as at least about 80%, and such as at least about 85%, 90%, or 95% identical, remain bound to each other. Definitions of low stringency, moderate, and high stringency hybridization conditions are provided herein below. Appropriate hybridization conditions can also be selected by those skilled in the art with minimal experimentation as exemplified in Ausubel et al. (1995, *Current Protocols in Molecular Biology*, John Wiley & Sons, sections 2, 4, and 6). Additionally, stringency conditions are described in Sambrook et al. (1989, *Molecular Cloning: A Laboratory Manual,* 2nd ed., Cold Spring Harbor Press, chapters 7, 9, and 11).

"Recombinant nucleic acid sequences" are nucleic acid sequences that result from the use of laboratory methods (for example, molecular cloning) to bring together genetic material from more than on source, creating or modifying a nucleic acid sequence that does not occur naturally and would not be otherwise found in biological organisms.

"Recombinant DNA technology" refers to molecular biology procedures to prepare a recombinant nucleic acid sequence as described, for instance, in Laboratory Manuals edited by Weigel and Glazebrook, 2002, Cold Spring Harbor Lab Press; and Sambrook et al., 1989, Cold Spring Harbor, NY, Cold Spring Harbor Laboratory Press.

The term "gene" means a DNA sequence comprising a region, which is transcribed into a RNA molecule, e.g., an mRNA in a cell, operably linked to suitable regulatory regions, e.g., a promoter. A gene may thus comprise several operably linked sequences, such as a promoter, a 5' leader sequence comprising, e.g., sequences involved in translation initiation, a coding region of cDNA or genomic DNA, introns, exons, and/or a 3'non-translated sequence comprising, e.g., transcription termination sites.

"Polycistronic" refers to nucleic acid molecules, in particular mRNAs, that can encode more than one polypeptide separately within the same nucleic acid molecule A "chimeric gene" refers to any gene which is not normally found in nature in a species, in particular, a gene in which one or more parts of the nucleic acid sequence are present that are not associated with each other in nature. For example the promoter is not associated in nature with part or all of the transcribed region or with another regulatory region. The term "chimeric gene" is understood to include expression constructs in which a promoter or transcription regulatory sequence is operably linked to one or more coding sequences or to an antisense, i.e., reverse complement of the sense strand, or inverted repeat sequence (sense and antisense, whereby the RNA transcript forms double stranded RNA upon transcription). The term "chimeric gene" also includes genes obtained through the combination of portions of one or more coding sequences to produce a new gene.

A "3' UTR" or "3' non-translated sequence" (also referred to as "3' untranslated region," or "3'end") refers to the nucleic acid sequence found downstream of the coding sequence of a gene, which comprises, for example, a transcription termination site and (in most, but not all eukaryotic mRNAs) a polyadenylation signal such as AAUAAA or variants thereof. After termination of transcription, the mRNA transcript may be cleaved downstream of the polyadenylation signal and a poly(A) tail may be added, which is involved in the transport of the mRNA to the site of translation, e.g., cytoplasm.

The term "primer" refers to a short nucleic acid sequence that is hybridized to a template nucleic acid sequence and is used for polymerization of a nucleic acid sequence complementary to the template.

The term "selectable marker" refers to any gene which upon expression may be used to select a cell or cells that include the selectable marker. Examples of selectable markers are described below. The skilled artisan will know that different antibiotic, fungicide, auxotrophic or herbicide selectable markers are applicable to different target species.

The invention also relates to nucleic acid sequences that code for polypeptides as defined herein.

In particular, the invention also relates to nucleic acid sequences (single-stranded and double-stranded DNA and RNA sequences, e.g. cDNA, genomic DNA and mRNA), coding for one of the above polypeptides and their functional equivalents, which can be obtained for example using artificial nucleotide analogs.

The invention relates both to isolated nucleic acid molecules, which code for polypeptides according to the invention or biologically active segments thereof, and to nucleic acid fragments, which can be used for example as hybridization probes or primers for identifying or amplifying coding nucleic acids according to the invention.

The present invention also relates to nucleic acids with a certain degree of "identity" to the sequences specifically disclosed herein. "Identity" between two nucleic acids means identity of the nucleotides, in each case over the entire length of the nucleic acid.

The "identity" between two nucleotide sequences (the same applies to peptide or amino acid sequences) is a function of the number of nucleotide residues (or amino acid residues) or that are identical in the two sequences when an alignment of these two sequences has been generated. Identical residues are defined as residues that are the same in the two sequences in a given position of the alignment. The percentage of sequence identity, as used herein, is calculated from the optimal alignment by taking the number of residues identical between two sequences dividing it by the total number of residues in the shortest sequence and multiplying by 100. The optimal alignment is the alignment in which the percentage of identity is the highest possible. Gaps may be introduced into one or both sequences in one or more positions of the alignment to obtain the optimal alignment. These gaps are then taken into account as non-identical residues for the calculation of the percentage of sequence identity. Alignment for the purpose of determining the percentage of amino acid or nucleic acid sequence identity can be achieved in various ways using computer programs and for instance publicly available computer programs available on the world wide web.

Particularly, the BLAST program (Tatiana et al, *FEMS Microbiol Lett.,* 1999, 174:247-250, 1999) set to the default parameters, available from the National Center for Biotechnology Information (NCBI) website at ncbi.nlm.nih.gov/BLAST/bl2seq/wblast2.cgi, can be used to obtain an optimal alignment of protein or nucleic acid sequences and to calculate the percentage of sequence identity.

In another example the identity may be calculated by means of the Vector NTI Suite 7.1 program of the company Informax (USA) employing the Clustal Method (Higgins D G, Sharp P M. ((1989))) with the following settings:

Multiple Alignment Parameters:

| | |
|---|---|
| Gap opening penalty | 10 |
| Gap extension penalty | 10 |

-continued

| | |
|---|---|
| Gap separation penalty range | 8 |
| Gap separation penalty | off |
| % identity for alignment delay | 40 |
| Residue specific gaps | off |
| Hydrophilic residue gap | off |
| Transition weighing | 0 |

Pairwise Alignment Parameter:

| | |
|---|---|
| FAST algorithm | on |
| K-tuple size | 1 |
| Gap penalty | 3 |
| Window size | 5 |
| Number of best diagonals | 5 |

Alternatively the identity may be determined according to Chenna, et al. (2003), the web page: http://www.ebi.ac.uk/Tools/clustalw/index.html# and the following settings

| | |
|---|---|
| DNA Gap Open Penalty | 15.0 |
| DNA Gap Extension Penalty | 6.66 |
| DNA Matrix | Identity |
| Protein Gap Open Penalty | 10.0 |
| Protein Gap Extension Penalty | 0.2 |
| Protein matrix | Gonnet |
| Protein/DNA ENDGAP | −1 |
| Protein/DNA GAPDIST | 4 |

All the nucleic acid sequences mentioned herein (single-stranded and double-stranded DNA and RNA sequences, for example cDNA and mRNA) can be produced in a known way by chemical synthesis from the nucleotide building blocks, e.g. by fragment condensation of individual overlapping, complementary nucleic acid building blocks of the double helix. Chemical synthesis of oligonucleotides can, for example, be performed in a known way, by the phosphoamidite method (Voet, Voet, 2nd edition, Wiley Press, New York, pages 896-897). The accumulation of synthetic oligonucleotides and filling of gaps by means of the Klenow fragment of DNA polymerase and ligation reactions as well as general cloning techniques are described in Sambrook et al. (1989), see below.

The nucleic acid molecules according to the invention can in addition contain non-translated sequences from the 3' and/or 5' end of the coding genetic region.

The invention further relates to the nucleic acid molecules that are complementary to the concretely described nucleotide sequences or a segment thereof.

The nucleotide sequences according to the invention make possible the production of probes and primers that can be used for the identification and/or cloning of homologous sequences in other cellular types and organisms. Such probes or primers generally comprise a nucleotide sequence region which hybridizes under "stringent" conditions (as defined herein elsewhere) on at least about 12, preferably at least about 25, for example about 40, 50 or 75 successive nucleotides of a sense strand of a nucleic acid sequence according to the invention or of a corresponding antisense strand.

"Homologous" sequences include orthologous or paralogous sequences. Methods of identifying orthologs or paralogs including phylogenetic methods, sequence similarity and hybridization methods are known in the art and are described herein.

"Paralogs" result from gene duplication that gives rise to two or more genes with similar sequences and similar functions. Paralogs typically cluster together and are formed by duplications of genes within related plant species. Paralogs are found in groups of similar genes using pair-wise Blast analysis or during phylogenetic analysis of gene families using programs such as CLUSTAL. In paralogs, consensus sequences can be identified characteristic to sequences within related genes and having similar functions of the genes.

"Orthologs", or orthologous sequences, are sequences similar to each other because they are found in species that descended from a common ancestor. For instance, plant species that have common ancestors are known to contain many enzymes that have similar sequences and functions. The skilled artisan can identify orthologous sequences and predict the functions of the orthologs, for example, by constructing a polygenic tree for a gene family of one species using CLUSTAL or BLAST programs. A method for identifying or confirming similar functions among homologous sequences is by comparing of the transcript profiles in host cells or organisms, such as plants or microorganisms, overexpressing or lacking (in knockouts/knockdowns) related polypeptides. The skilled person will understand that genes having similar transcript profiles, with greater than 50% regulated transcripts in common, or with greater than 70% regulated transcripts in common, or greater than 90% regulated transcripts in common will have similar functions. Homologs, paralogs, orthologs and any other variants of the sequences herein are expected to function in a similar manner by making the host cells, organism such as plants or microorganisms producing LOX proteins.

The term "selectable marker" refers to any gene which upon expression may be used to select a cell or cells that include the selectable marker. Examples of selectable markers are described below. The skilled artisan will know that different antibiotic, fungicide, auxotrophic or herbicide selectable markers are applicable to different target species.

An "isolated" nucleic acid molecule is separated from other nucleic acid molecules that are present in the natural source of the nucleic acid and can moreover be substantially free from other cellular material or culture medium, if it is being produced by recombinant techniques, or can be free from chemical precursors or other chemicals, if it is being synthesized chemically.

A nucleic acid molecule according to the invention can be isolated by means of standard techniques of molecular biology and the sequence information supplied according to the invention. For example, cDNA can be isolated from a suitable cDNA library, using one of the concretely disclosed complete sequences or a segment thereof as hybridization probe and standard hybridization techniques (as described for example in Sambrook, (1989)).

In addition, a nucleic acid molecule comprising one of the disclosed sequences or a segment thereof, can be isolated by the polymerase chain reaction, using the oligonucleotide primers that were constructed on the basis of this sequence. The nucleic acid amplified in this way can be cloned in a suitable vector and can be characterized by DNA sequencing. The oligonucleotides according to the invention can also be produced by standard methods of synthesis, e.g. using an automatic DNA synthesizer.

Nucleic acid sequences according to the invention or derivatives thereof, homologues or parts of these sequences, can for example be isolated by usual hybridization techniques or the PCR technique from other bacteria, e.g. via genomic or cDNA libraries. These DNA sequences hybridize in standard conditions with the sequences according to the invention.

"Hybridize" means the ability of a polynucleotide or oligonucleotide to bind to an almost complementary sequence in standard conditions, whereas nonspecific binding does not occur between non-complementary partners in these conditions. For this, the sequences can be 90-100% complementary. The property of complementary sequences of being able to bind specifically to one another is utilized for example in Northern Blotting or Southern Blotting or in primer binding in PCR or RT-PCR.

Short oligonucleotides of the conserved regions are used advantageously for hybridization. However, it is also possible to use longer fragments of the nucleic acids according to the invention or the complete sequences for the hybridization. These "standard conditions" vary depending on the nucleic acid used (oligonucleotide, longer fragment or complete sequence) or depending on which type of nucleic acid—DNA or RNA—is used for hybridization. For example, the melting temperatures for DNA:DNA hybrids are approx. 10° C. lower than those of DNA:RNA hybrids of the same length.

For example, depending on the particular nucleic acid, standard conditions mean temperatures between 42 and 58° C. in an aqueous buffer solution with a concentration between 0.1 to 5×SSC (1×SSC=0.15 M NaCl, 15 mM sodium citrate, pH 7.2) or additionally in the presence of 50% formamide, for example 42° C. in 5×SSC, 50% formamide. Advantageously, the hybridization conditions for DNA:DNA hybrids are 0.1×SSC and temperatures between about 20° C. to 45° C., preferably between about 30° C. to 45° C. For DNA:RNA hybrids the hybridization conditions are advantageously 0.1×SSC and temperatures between about 30° C. to 55° C., preferably between about 45° C. to 55° C. These stated temperatures for hybridization are examples of calculated melting temperature values for a nucleic acid with a length of approx. 100 nucleotides and a G+C content of 50% in the absence of formamide. The experimental conditions for DNA hybridization are described in relevant genetics textbooks, for example Sambrook et al., 1989, and can be calculated using formulae that are known by a person skilled in the art, for example depending on the length of the nucleic acids, the type of hybrids or the G+C content. A person skilled in the art can obtain further information on hybridization from the following textbooks: Ausubel et al. (eds), (1985), Brown (ed) (1991).

"Hybridization" can in particular be carried out under stringent conditions. Such hybridization conditions are for example described in Sambrook (1989), or in Current Protocols in Molecular Biology, John Wiley & Sons, N.Y. (1989), 6.3.1-6.3.6.

As used herein, the term hybridization or hybridizes under certain conditions is intended to describe conditions for hybridization and washes under which nucleotide sequences that are significantly identical or homologous to each other remain bound to each other. The conditions may be such that sequences, which are at least about 70%, such as at least about 80%, and such as at least about 85%, 90%, or 95% identical, remain bound to each other. Definitions of low stringency, moderate, and high stringency hybridization conditions are provided herein.

Appropriate hybridization conditions can be selected by those skilled in the art with minimal experimentation as exemplified in Ausubel et al. (1995, *Current Protocols in Molecular Biology*, John Wiley & Sons, sections 2, 4, and 6). Additionally, stringency conditions are described in Sambrook et al. (1989, *Molecular Cloning: A Laboratory Manual,* 2nd ed., Cold Spring Harbor Press, chapters 7, 9, and 11).

As used herein, defined conditions of low stringency are as follows. Filters containing DNA are pretreated for 6 h at 40° C. in a solution containing 35% formamide, 5×SSC, 50 mM Tris-HCl (pH 7.5), 5 mM EDTA, 0.1% PVP, 0.1% Ficoll, 1% BSA, and 500 μg/ml denatured salmon sperm DNA. Hybridizations are carried out in the same solution with the following modifications: 0.02% PVP, 0.02% Ficoll, 0.2% BSA, 100 μg/ml salmon sperm DNA, 10% (wt/vol) dextran sulfate, and 5-20×106 32P-labeled probe is used. Filters are incubated in hybridization mixture for 18-20 h at 40° C., and then washed for 1.5 h at 55° C. In a solution containing 2×SSC, 25 mM Tris-HCl (pH 7.4), 5 mM EDTA, and 0.1% SDS. The wash solution is replaced with fresh solution and incubated an additional 1.5 h at 60° C. Filters are blotted dry and exposed for autoradiography.

As used herein, defined conditions of moderate stringency are as follows. Filters containing DNA are pretreated for 7 h at 50° C. in a solution containing 35% formamide, 5×SSC, 50 mM Tris-HCl (pH 7.5), 5 mM EDTA, 0.1% PVP, 0.1% Ficoll, 1% BSA, and 500 μg/ml denatured salmon sperm DNA. Hybridizations are carried out in the same solution with the following modifications: 0.02% PVP, 0.02% Ficoll, 0.2% BSA, 100 μg/ml salmon sperm DNA, 10% (wt/vol) dextran sulfate, and 5-20×106 32P-labeled probe is used. Filters are incubated in hybridization mixture for 30 h at 50° C., and then washed for 1.5 h at 55° C. In a solution containing 2×SSC, 25 mM Tris-HCl (pH 7.4), 5 mM EDTA, and 0.1% SDS. The wash solution is replaced with fresh solution and incubated an additional 1.5 h at 60° C. Filters are blotted dry and exposed for autoradiography.

As used herein, defined conditions of high stringency are as follows. Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 μg/ml denatured salmon sperm DNA. Filters are hybridized for 48 h at 65° C. in the prehybridization mixture containing 100 μg/ml denatured salmon sperm DNA and 5-20×106 cpm of 32P-labeled probe. Washing of filters is done at 37° C. for 1 h in a solution containing 2×SSC, 0.01% PVP, 0.01% Ficoll, and 0.01% BSA. This is followed by a wash in 0.1×SSC at 50° C. for 45 minutes.

Other conditions of low, moderate, and high stringency well known in the art (e.g., as employed for cross-species hybridizations) may be used if the above conditions are inappropriate (e.g., as employed for cross-species hybridizations).

A detection kit for nucleic acid sequences encoding a polypeptide of the invention may include primers and/or probes specific for nucleic acid sequences encoding the polypeptide, and an associated protocol to use the primers and/or probes to detect nucleic acid sequences encoding the polypeptide in a sample. Such detection kits may be used to determine whether a plant, organism, microorganism or cell has been modified, i.e., transformed with a sequence encoding the polypeptide.

To test a function of variant DNA sequences according to an embodiment herein, the sequence of interest is operably linked to a selectable or screenable marker gene and expression of said reporter gene is tested in transient expression assays, for example, with microorganisms or with protoplasts or in stably transformed plants.

The invention also relates to derivatives of the concretely disclosed or derivable nucleic acid sequences.

Thus, further nucleic acid sequences according to the invention can be derived from the sequences specifically disclosed herein and can differ from it by one or more, like 1 to 20, in particular 1 to 15 or 5 to 10 additions, substitutions, insertions or deletions of one or several (like for example 1 to 10) nucleotides, and furthermore code for polypeptides with the desired profile of properties.

The invention also encompasses nucleic acid sequences that comprise so-called silent mutations or have been altered, in comparison with a concretely stated sequence, according to the codon usage of a special original or host organism.

According to a particular embodiment of the invention variant nucleic acids may be prepared in order to adapt its nucleotide sequence to a specific expression system. For example, bacterial expression systems are known to more efficiently express polypeptides if amino acids are encoded by particular codons. Due to the degeneracy of the genetic code, more than one codon may encode the same amino acid sequence, multiple nucleic acid sequences can code for the same protein or polypeptide, all these DNA sequences being encompassed by an embodiment herein. Where appropriate, the nucleic acid sequences encoding the polypeptides described herein may be optimized for increased expression in the host cell. For example, nucleic acids of an embodiment herein may be synthesized using codons particular to a host for improved expression.

The invention also encompasses naturally occurring variants, e.g. splicing variants or allelic variants, of the sequences described therein.

Allelic variants may have at least 60% homology at the level of the derived amino acid, preferably at least 80% homology, quite especially preferably at least 90% homology over the entire sequence range (regarding homology at the amino acid level, reference should be made to the details given above for the polypeptides). Advantageously, the homologies can be higher over partial regions of the sequences.

The invention also relates to sequences that can be obtained by conservative nucleotide substitutions (i.e. as a result thereof the amino acid in question is replaced by an amino acid of the same charge, size, polarity and/or solubility).

The invention also relates to the molecules derived from the concretely disclosed nucleic acids by sequence polymorphisms. Such genetic polymorphisms may exist in cells from different populations or within a population due to natural allelic variation. Allelic variants may also include functional equivalents. These natural variations usually produce a variance of 1 to 5% in the nucleotide sequence of a gene. Said polymorphisms may lead to changes in the amino acid sequence of the polypeptides disclosed herein. Allelic variants may also include functional equivalents.

Furthermore, derivatives are also to be understood to be homologs of the nucleic acid sequences according to the invention, for example animal, plant, fungal or bacterial homologs, shortened sequences, single-stranded DNA or RNA of the coding and noncoding DNA sequence. For example, homologs have, at the DNA level, a homology of at least 40%, preferably of at least 60%, especially preferably of at least 70%, quite especially preferably of at least 80% over the entire DNA region given in a sequence specifically disclosed herein.

Moreover, derivatives are to be understood to be, for example, fusions with promoters. The promoters that are added to the stated nucleotide sequences can be modified by at least one nucleotide exchange, at least one insertion, inversion and/or deletion, though without impairing the functionality or efficacy of the promoters. Moreover, the efficacy of the promoters can be increased by altering their sequence or can be exchanged completely with more effective promoters even of organisms of a different genus.

d. Generation of Functional Polypeptide Mutants

Moreover, a person skilled in the art is familiar with methods for generating functional mutants, that is to say nucleotide sequences which code for a polypeptide with at least 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% sequence identity to anyone of amino acid related SEQ ID NOs as disclosed herein and/or encoded by a nucleic acid molecule comprising a nucleotide sequence having at least 70% sequence identity to anyone of the nucleotide related SEQ ID NOs as disclosed herein.

Depending on the technique used, a person skilled in the art can introduce entirely random or else more directed mutations into genes or else noncoding nucleic acid regions (which are for example important for regulating expression) and subsequently generate genetic libraries. The methods of molecular biology required for this purpose are known to the skilled worker and for example described in Sambrook and Russell, Molecular Cloning. 3rd Edition, Cold Spring Harbor Laboratory Press 2001.

Methods for modifying genes and thus for modifying the polypeptide encoded by them have been known to the skilled worker for a long time, such as, for example

- direct synthesis of the whole coding sequence with different methods (Sriram Kosuri and George M Church, 2014, Nature Methods, 11: 499-507),
- site-specific mutagenesis, where individual or several nucleotides of a gene are replaced in a directed fashion (Trower M K (Ed.) 1996; In vitro mutagenesis protocols. Humana Press, New Jersey),
- saturation mutagenesis, in which a codon for any amino acid can be exchanged or added at any point of a gene (Kegler-Ebo D M, Docktor C M, DiMaio D (1994) Nucleic Acids Res 22:1593; Barettino D, Feigenbutz M, Valcárel R, Stunnenberg H G (1994) Nucleic Acids Res 22:541; Barik S (1995) Mol Biotechnol 3:1),
- error-prone polymerase chain reaction, where nucleotide sequences are mutated by error-prone DNA polymerases (Eckert K A, Kunkel T A (1990) Nucleic Acids Res 18:3739);
- the SeSaM method (sequence saturation method), in which preferred exchanges are prevented by the polymerase. Schenk et al., Biospektrum, Vol. 3, 2006, 277-279
- the passaging of genes in mutator strains, in which, for example owing to defective DNA repair mechanisms, there is an increased mutation rate of nucleotide sequences (Greener A, Callahan M, Jerpseth B (1996) An efficient random mutagenesis technique using an *E. coli* mutator strain. In: Trower M K (Ed.) In vitro mutagenesis protocols. Humana Press, New Jersey), or
- DNA shuffling, in which a pool of closely related genes is formed and digested and the fragments are used as templates for a polymerase chain reaction in which, by repeated strand separation and reassociation, full-length mosaic genes are ultimately generated (Stemmer W P C (1994) Nature 370:389; Stemmer W P C (1994) Proc Natl Acad Sci USA 91:10747).

Using so-called directed evolution (described, inter alia, in Reetz M T and Jaeger K-E (1999), Topics Curr Chem 200:31; Zhao H, Moore J C, Volkov A A, Arnold F H (1999), Methods for optimizing industrial polypeptides by directed evolution, In: Demain A L, Davies J E (Ed.) Manual of industrial microbiology and biotechnology. American Society for Microbiology), a skilled worker can produce functional mutants in a directed manner and on a large scale. To this end, in a first step, gene libraries of the respective polypeptides are first produced, for example using the methods given above. The gene libraries are expressed in a suitable way, for example by bacteria or by phage display systems.

The relevant genes of host organisms which express functional mutants with properties that largely correspond to the desired properties can be submitted to another mutation cycle. The steps of the mutation and selection or screening can be repeated iteratively until the present functional mutants have the desired properties to a sufficient extent. Using this iterative procedure, a limited number of mutations, for example 1, 2, 3, 4 or 5 mutations, can be performed in stages and assessed and selected for their influence on the activity in question. The selected mutant can then be submitted to a further mutation step in the same way. In this way, the number of individual mutants to be investigated can be reduced significantly.

The results according to the invention also provide important information relating to structure and sequence of the relevant polypeptides, which is required for generating, in a targeted fashion, further polypeptides with desired modified properties. In particular, it is possible to define so-called "hot spots", i.e. sequence segments that are potentially suitable for modifying a property by introducing targeted mutations.

Information can also be deduced regarding amino acid sequence positions, in the region of which mutations can be effected that should probably have little effect on the activity, and can be designated as potential "silent mutations".

e. Constructs for Expressing Polypeptides of the Invention

In this context the following definitions apply:

"Expression of a gene" encompasses "heterologous expression" and "overexpression" and involves transcription of the gene and translation of the mRNA into a protein. Overexpression refers to the production of the gene product as measured by levels of mRNA, polypeptide and/or enzyme activity in transgenic cells or organisms that exceeds levels of production in non-transformed cells or organisms of a similar genetic background.

"Expression vector" as used herein means a nucleic acid molecule engineered using molecular biology methods and recombinant DNA technology for delivery of foreign or exogenous DNA into a host cell. The expression vector typically includes sequences required for proper transcription of the nucleotide sequence. The coding region usually codes for a protein of interest but may also code for an RNA, e.g., an antisense RNA, siRNA and the like.

An "expression vector" as used herein includes any linear or circular recombinant vector including but not limited to viral vectors, bacteriophages and plasmids. The skilled person is capable of selecting a suitable vector according to the expression system. In one embodiment, the expression vector includes the nucleic acid of an embodiment herein operably linked to at least one "regulatory sequence", which controls transcription, translation, initiation and termination, such as a transcriptional promoter, operator or enhancer, or an mRNA ribosomal binding site and, optionally, including at least one selection marker. Nucleotide sequences are "operably linked" when the regulatory sequence functionally relates to the nucleic acid of an embodiment herein.

An "expression system" as used herein encompasses any combination of nucleic acid molecules required for the expression of one, or the co-expression of two or more polypeptides either in vivo of a given expression host, or in vitro. The respective coding sequences may either be located on a single nucleic acid molecule or vector, as for example a vector containing multiple cloning sites, or on a polycistronic nucleic acid, or may be distributed over two or more physically distinct vectors. As a particular example there may be mentioned an operon comprising a promotor sequence, one or more operator sequences and one or more structural genes each encoding an enzyme as described herein.

As used herein, the terms "amplifying" and "amplification" refer to the use of any suitable amplification methodology for generating or detecting recombinant of naturally expressed nucleic acid, as described in detail, below. For example, the invention provides methods and reagents (e.g., specific degenerate oligonucleotide primer pairs, oligo dT primer) for amplifying (e.g., by polymerase chain reaction, PCR) naturally expressed (e.g., genomic DNA or mRNA) or recombinant (e.g., cDNA) nucleic acids of the invention in vivo, ex vivo or in vitro.

"Regulatory sequence" refers to a nucleic acid sequence that determines expression level of the nucleic acid sequences of an embodiment herein and is capable of regulating the rate of transcription of the nucleic acid sequence operably linked to the regulatory sequence. Regulatory sequences comprise promoters, enhancers, transcription factors, promoter elements and the like.

A "promoter", a "nucleic acid with promoter activity" or a "promoter sequence" is understood as meaning, in accordance with the invention, a nucleic acid which, when functionally linked to a nucleic acid to be transcribed, regulates the transcription of said nucleic acid. "Promoter" in particular refers to a nucleic acid sequence that controls the expression of a coding sequence by providing a binding site for RNA polymerase and other factors required for proper transcription including without limitation transcription factor binding sites, repressor and activator protein binding sites. The meaning of the term promoter also includes the term "promoter regulatory sequence". Promoter regulatory sequences may include upstream and downstream elements that may influences transcription, RNA processing or stability of the associated coding nucleic acid sequence. Promoters include naturally-derived and synthetic sequences. The coding nucleic acid sequences is usually located downstream of the promoter with respect to the direction of the transcription starting at the transcription initiation site.

In this context, a "functional" or "operative" linkage is understood as meaning for example the sequential arrangement of one of the nucleic acids with a regulatory sequence. For example the sequence with promoter activity and of a nucleic acid sequence to be transcribed and optionally further regulatory elements, for example nucleic acid sequences which ensure the transcription of nucleic acids, and for example a terminator, are linked in such a way that each of the regulatory elements can perform its function upon transcription of the nucleic acid sequence. This does not necessarily require a direct linkage in the chemical sense. Genetic control sequences, for example enhancer sequences, can even exert their function on the target sequence from more remote positions or even from other DNA molecules. Preferred arrangements are those in which the nucleic acid sequence to be transcribed is positioned behind (i.e. at the 3'-end of) the promoter sequence so that the two sequences are joined together covalently. The distance between the promoter sequence and the nucleic acid sequence to be expressed recombinantly can be smaller than 200 base pairs, or smaller than 100 base pairs or smaller than 50 base pairs.

In addition to promoters and terminator, the following may be mentioned as examples of other regulatory elements: targeting sequences, enhancers, polyadenylation signals, selectable markers, amplification signals, replication origins and the like. Suitable regulatory sequences are described, for example, in Goeddel, Gene Expression Technology: Methods in Enzymology 185, Academic Press, San Diego, CA (1990). The term "constitutive promoter" refers to an unregulated promoter that allows for continual transcription of the nucleic acid sequence it is operably linked to.

As used herein, the term "operably linked" refers to a linkage of polynucleotide elements in a functional relationship. A nucleic acid is "operably linked" when it is placed into a functional relationship with another nucleic acid sequence. For instance, a promoter, or rather a transcription regulatory sequence, is operably linked to a coding sequence if it affects the transcription of the coding sequence. Operably linked means that the DNA sequences being linked are typically contiguous. The nucleotide sequence associated with the promoter sequence may be of homologous or heterologous origin with respect to the plant to be transformed. The sequence also may be entirely or partially synthetic. Regardless of the origin, the nucleic acid sequence associated with the promoter sequence will be expressed or silenced in accordance with promoter properties to which it is linked after binding to the polypeptide of an embodiment herein. The associated nucleic acid may code for a protein that is desired to be expressed or suppressed throughout the organism at all times or, alternatively, at a specific time or in specific tissues, cells, or cell compartment. Such nucleotide sequences particularly encode proteins conferring desirable phenotypic traits to the host cells or organism altered or transformed therewith. More particularly, the associated nucleotide sequence leads to the production of the product or products of interest as herein defined in the cell or organism. Particularly, the nucleotide sequence encodes a polypeptide having an enzyme activity as herein defined.

The nucleotide sequence as described herein above may be part of an "expression cassette". The terms "expression cassette" and "expression construct" are used synonymously. The (preferably recombinant) expression construct contains a nucleotide sequence which encodes a polypeptide according to the invention and which is under genetic control of regulatory nucleic acid sequences.

In a process applied according to the invention, the expression cassette may be part of an "expression vector", in particular of a recombinant expression vector.

An "expression unit" is understood as meaning, in accordance with the invention, a nucleic acid with expression activity which comprises a promoter as defined herein and, after functional linkage with a nucleic acid to be expressed or a gene, regulates the expression, i.e. the transcription and the translation of said nucleic acid or said gene. It is therefore in this connection also referred to as a "regulatory nucleic acid sequence". In addition to the promoter, other regulatory elements, for example enhancers, can also be present.

An "expression cassette" or "expression construct" is understood as meaning, in accordance with the invention, an expression unit which is functionally linked to the nucleic acid to be expressed or the gene to be expressed. In contrast to an expression unit, an expression cassette therefore comprises not only nucleic acid sequences which regulate transcription and translation, but also the nucleic acid sequences that are to be expressed as protein as a result of transcription and translation.

The terms "expression" or "overexpression" describe, in the context of the invention, the production or increase in intracellular activity of one or more polypeptides in a microorganism, which are encoded by the corresponding DNA. To this end, it is possible for example to introduce a gene into an organism, replace an existing gene with another gene, increase the copy number of the gene(s), use a strong promoter or use a gene which encodes for a corresponding polypeptide with a high activity; optionally, these measures can be combined.

Preferably such constructs according to the invention comprise a promoter 5'-upstream of the respective coding sequence and a terminator sequence 3'-downstream and optionally other usual regulatory elements, in each case in operative linkage with the coding sequence.

Nucleic acid constructs according to the invention comprise in particular a sequence coding for a polypeptide for example derived from the amino acid related SEQ ID NOs as described therein or the reverse complement thereof, or derivatives and homologs thereof and which have been linked operatively or functionally with one or more regulatory signals, advantageously for controlling, for example increasing, gene expression.

In addition to these regulatory sequences, the natural regulation of these sequences may still be present before the actual structural genes and optionally may have been genetically modified so that the natural regulation has been switched off and expression of the genes has been enhanced. The nucleic acid construct may, however, also be of simpler construction, i.e. no additional regulatory signals have been inserted before the coding sequence and the natural promoter, with its regulation, has not been removed. Instead, the natural regulatory sequence is mutated such that regulation no longer takes place and the gene expression is increased.

A preferred nucleic acid construct advantageously also comprises one or more of the already mentioned "enhancer" sequences in functional linkage with the promoter, which sequences make possible an enhanced expression of the nucleic acid sequence. Additional advantageous sequences may also be inserted at the 3'-end of the DNA sequences, such as further regulatory elements or terminators. One or more copies of the nucleic acids according to the invention may be present in a construct. In the construct, other markers, such as genes which complement auxotrophisms or antibiotic resistances, may also optionally be present so as to select for the construct.

Examples of suitable regulatory sequences are present in promoters such as cos, tac, trp, tet, trp-tet, lpp, lac, lpp-lac, $lacI^q$, T7, T5, T3, gal, trc, ara, rhaP ($rhaP_{BAD}$)SP6, lambda-$P_R$ or in the lambda-$P_L$ promoter, and these are advantageously employed in Gram-negative bacteria. Further advantageous regulatory sequences are present for example in the Gram-positive promoters amy and SPO2, in the yeast or fungal promoters ADC1, MFalpha, AC, P-60, CYC1, GAPDH, TEF, rp28, ADH. Artificial promoters may also be used for regulation.

For expression in a host organism, the nucleic acid construct is inserted advantageously into a vector such as, for example, a plasmid or a phage, which makes possible optimal expression of the genes in the host. Vectors are also understood as meaning, in addition to plasmids and phages, all the other vectors which are known to the skilled worker, that is to say for example viruses such as SV40, CMV, baculovirus and adenovirus, transposons, IS elements, phasmids, cosmids and linear or circular DNA or artificial chromosomes. These vectors are capable of replicating autonomously in the host organism or else chromosomally. These vectors are a further development of the invention. Binary or cpo-integration vectors are also applicable.

Suitable plasmids are, for example, in *E. coli* pLG338, pACYC184, pBR322, pUC18, pUC19, pKC30, pRep4, pHS1, pKK223-3, pDHE19.2, pHS2, pPLc236, pMBL24, pLG200, pUR290, pIN-III$^{113}$-B1, λgt11 or pBdCI, in *Streptomyces* pIJ101, pIJ364, pIJ702 or pIJ361, in *Bacillus* pUB110, pC194 or pBD214, in *Corynebacterium* pSA77 or pAJ667, in fungi pALS1, pIL2 or pBB116, in yeasts 2alphaM, pAG-1, YEp6, YEp13 or pEMBLYe23 or in plants pLGV23, pGHlac$^{+}$, pBIN19, pAK2004 or pDH51. The abovementioned plasmids are a small selection of the plasmids which are possible. Further plasmids are well known to the skilled worker and can be found for example in the book Cloning Vectors (Eds. Pouwels P. H. et al. Elsevier, Amsterdam-New York-Oxford, 1985, ISBN 0444904018).

In a further development of the vector, the vector which comprises the nucleic acid construct according to the invention or the nucleic acid according to the invention can advantageously also be introduced into the microorganisms in the form of a linear DNA and integrated into the host organism's genome via heterologous or homologous recombination. This linear DNA can consist of a linearized vector such as a plasmid or only of the nucleic acid construct or the nucleic acid according to the invention.

For optimal expression of heterologous genes in organisms, it is advantageous to modify the nucleic acid sequences to match the specific "codon usage" used in the organism. The "codon usage" can be determined readily by computer evaluations of other, known genes of the organism in question.

An expression cassette according to the invention is generated by fusing a suitable promoter to a suitable coding nucleotide sequence and a terminator or polyadenylation signal. Customary recombination and cloning techniques are used for this purpose, as are described, for example, in T. Maniatis, E. F. Fritsch and J. Sambrook, Molecular Cloning: A Laboratory Manual, Cold Spring Harbor Laboratory, Cold Spring Harbor, NY (1989) and in T. J. Silhavy, M. L. Berman and L. W. Enquist, Experiments with Gene Fusions, Cold Spring Harbor Laboratory, Cold Spring Harbor, NY (1984) and in Ausubel, F. M. et al., Current Protocols in Molecular Biology, Greene Publishing Assoc. and Wiley Interscience (1987).

For expression in a suitable host organism, the recombinant nucleic acid construct or gene construct is advantageously inserted into a host-specific vector which makes possible optimal expression of the genes in the host. Vectors are well known to the skilled worker and can be found for example in "cloning vectors" (Pouwels P. H. et al., Ed., Elsevier, Amsterdam-New York-Oxford, 1985).

An alternative embodiment of an embodiment herein provides a method to "alter gene expression" in a host cell. For instance, the polynucleotide of an embodiment herein may be enhanced or overexpressed or induced in certain contexts (e.g. upon exposure to certain temperatures or culture conditions) in a host cell or host organism.

Alteration of expression of a polynucleotide provided herein may also result in ectopic expression which is a different expression pattern in an altered and in a control or wild-type organism. Alteration of expression occurs from interactions of polypeptide of an embodiment herein with exogenous or endogenous modulators, or as a result of chemical modification of the polypeptide. The term also refers to an altered expression pattern of the polynucleotide of an embodiment herein which is altered below the detection level or completely suppressed activity. In one embodiment, provided herein is also an isolated, recombinant or synthetic polynucleotide encoding a polypeptide or variant polypeptide provided herein.

In one embodiment, several polypeptide encoding nucleic acid sequences are co-expressed in a single host, particularly under control of different promoters. In another embodiment, several polypeptide encoding nucleic acid sequences can be present on a single transformation vector or be co-transformed at the same time using separate vectors and selecting transformants comprising both chimeric genes. Similarly, one or polypeptide encoding genes may be expressed in a single plant, cell, microorganism or organism together with other chimeric genes.

f. Hosts to be Applied for the Present Invention

Depending on the context, the term "host" can mean the wild-type host or a genetically altered, recombinant host or both.

In principle, all prokaryotic or eukaryotic organisms may be considered as host or recombinant host organisms for the nucleic acids or the nucleic acid constructs according to the invention.

Using the vectors according to the invention, recombinant hosts can be produced, which are for example transformed with at least one vector according to the invention and can be used for producing the polypeptides according to the invention. Advantageously, the recombinant constructs according to the invention, described above, are introduced into a suitable host system and expressed. Preferably common cloning and transfection methods, known by a person skilled in the art, are used, for example co-precipitation, protoplast fusion, electroporation, retroviral transfection and the like, for expressing the stated nucleic acids in the respective expression system. Suitable systems are described for example in Current Protocols in Molecular Biology, F. Ausubel et al., Ed., Wiley Interscience, New York 1997, or Sambrook et al. Molecular Cloning: A Laboratory Manual. 2nd edition, Cold Spring Harbor Laboratory, Cold Spring Harbor Laboratory Press, Cold Spring Harbor, NY, 1989.

Advantageously, microorganisms such as bacteria, fungi or yeasts are used as host organisms. Advantageously, gram-positive or gram-negative bacteria are used, preferably bacteria of the families Enterobacteriaceae, Pseudomonadaceae, Rhizobiaceae, Streptomycetaceae, Streptococcaceae or Nocardiaceae, especially preferably bacteria of the genera *Escherichia, Pseudomonas, Streptomyces, Lactococcus, Nocardia, Burkholderia, Salmonella, Agrobacterium, Clostridium* or *Rhodococcus*. The genus and species *Escherichia coli* is quite especially preferred. Furthermore, other advantageous bacteria are to be found in the group of alpha-Proteobacteria, beta-Proteobacteria or gamma-Proteobacteria. Advantageously also yeasts of families like *Saccharomyces* or *Pichia* are suitable hosts.

Alternatively, entire plants or plant cells may serve as natural or recombinant host. As non-limiting examples the following plants or cells derived therefrom may be mentioned the genera *Nicotiana*, in particular *Nicotiana benthamiana* and *Nicotiana tabacum* (tobacco); as well as *Arabidopsis*, in particular *Arabidopsis thaliana.*

Depending on the host organism, the organisms used in the method according to the invention are grown or cultured in a manner known by a person skilled in the art. Culture can be batchwise, semi-batchwise or continuous. Nutrients can be present at the beginning of fermentation or can be supplied later, semicontinuously or continuously. This is also described in more detail below.

g. Recombinant Production of Polypeptides According to the Invention

The invention further relates to methods for recombinant production of polypeptides according to the invention or functional, biologically active fragments thereof, wherein a polypeptide-producing microorganism is cultured, optionally the expression of the polypeptides is induced by applying at least one inducer inducing gene expression and the expressed polypeptides are isolated from the culture. The polypeptides can also be produced in this way on an industrial scale, if desired.

The microorganisms produced according to the invention can be cultured continuously or discontinuously in the batch method or in the fed-batch method or repeated fed-batch method. A summary of known cultivation methods can be found in the textbook by Chmiel (Bioprozesstechnik 1. Einführung in die Bioverfahrenstechnik [Bioprocess technology 1. Introduction to bioprocess technology] (Gustav Fischer Verlag, Stuttgart, 1991)) or in the textbook by Storhas (Bioreaktoren and periphere Einrichtungen [Bioreactors and peripheral equipment] (Vieweg Verlag, Braunschweig/Wiesbaden, 1994)).

The culture medium to be used must suitably meet the requirements of the respective strains. Descriptions of culture media for various microorganisms are given in the manual "Manual of Methods for General Bacteriology" of the American Society for Bacteriology (Washington D. C., USA, 1981).

These media usable according to the invention usually comprise one or more carbon sources, nitrogen sources, inorganic salts, vitamins and/or trace elements.

Preferred carbon sources are sugars, such as mono-, di- or polysaccharides. Very good carbon sources are for example glucose, fructose, mannose, galactose, ribose, sorbose, ribulose, lactose, maltose, sucrose, raffinose, starch or cellulose. Sugars can also be added to the media via complex compounds, such as molasses, or other by-products of sugar refining. It can also be advantageous to add mixtures of different carbon sources. Other possible carbon sources are oils and fats, for example soybean oil, sunflower oil, peanut oil and coconut oil, fatty acids, for example palmitic acid, stearic acid or linoleic acid, alcohols, for example glycerol, methanol or ethanol and organic acids, for example acetic acid or lactic acid.

Nitrogen sources are usually organic or inorganic nitrogen compounds or materials that contain these compounds. Examples of nitrogen sources comprise ammonia gas or ammonium salts, such as ammonium sulfate, ammonium chloride, ammonium phosphate, ammonium carbonate or ammonium nitrate, nitrates, urea, amino acids or complex nitrogen sources, such as corn-steep liquor, soya flour, soya protein, yeast extract, meat extract and others. The nitrogen sources can be used alone or as a mixture.

Inorganic salt compounds that can be present in the media comprise the chloride, phosphorus or sulfate salts of calcium, magnesium, sodium, cobalt, molybdenum, potassium, manganese, zinc, copper and iron.

Inorganic sulfur-containing compounds, for example sulfates, sulfites, dithionites, tetrathionates, thiosulfates, sulfides, as well as organic sulfur compounds, such as mercaptans and thiols, can be used as the sulfur source.

Phosphoric acid, potassium dihydrogen phosphate or dipotassium hydrogen phosphate or the corresponding sodium-containing salts can be used as the phosphorus source.

Chelating agents can be added to the medium, in order to keep the metal ions in solution. Especially suitable chelating agents comprise dihydroxyphenols, such as catechol or protocatechuate, or organic acids, such as citric acid.

The fermentation media used according to the invention usually also contain other growth factors, such as vitamins or growth promoters, which include for example biotin, riboflavin, thiamine, folic acid, nicotinic acid, pantothenate and pyridoxine. Growth factors and salts often originate from the components of complex media, such as yeast extract, molasses, corn-steep liquor and the like. Moreover, suitable precursors can be added to the culture medium. The exact composition of the compounds in the medium is strongly dependent on the respective experiment and is decided for each specific case individually. Information on media optimization can be found in the textbook "Applied Microbiol. Physiology, A Practical Approach" (Ed. P. M. Rhodes, P. F. Stanbury, IRL Press (1997) p. 53-73, ISBN 0199635773). Growth media can also be obtained from commercial suppliers, such as Standard 1 (Merck) or BHI (brain heart infusion, DIFCO) and the like.

All components of the medium are sterilized, either by heat (20 min at 1.5 bar and 121° C.) or by sterile filtration. The components can either be sterilized together, or separately if necessary. All components of the medium can be present at the start of culture or can be added either continuously or batchwise.

The culture temperature is normally between 15° C. and 45° C., preferably 25° C. to 40° C. and can be varied or kept constant during the experiment. The pH of the medium should be in the range from 5 to 8.5, preferably around 7.0. The pH for growing can be controlled during growing by adding basic compounds such as sodium hydroxide, potassium hydroxide, ammonia or ammonia water or acid compounds such as phosphoric acid or sulfuric acid. Antifoaming agents, for example fatty acid polyglycol esters, can be used for controlling foaming. To maintain the stability of plasmids, suitable selective substances, for example antibiotics, can be added to the medium. To maintain aerobic conditions, oxygen or oxygen-containing gas mixtures, for example ambient air, are fed into the culture. The temperature of the culture is normally in the range from 20° C. to 45° C. The culture is continued until a maximum of the desired product has formed. This target is normally reached within 10 hours to 160 hours.

The fermentation broth is then processed further. Depending on requirements, the biomass can be removed from the fermentation broth completely or partially by separation techniques, for example centrifugation, filtration, decanting or a combination of these methods or can be left in it completely.

If the polypeptides are not secreted in the culture medium, the cells can also be lysed and the product can be obtained from the lysate by known methods for isolation of proteins. The cells can optionally be disrupted with high-frequency ultrasound, high pressure, for example in a French press, by osmolysis, by the action of detergents, lytic enzymes or organic solvents, by means of homogenizers or by a combination of several of the aforementioned methods.

The polypeptides can be purified by known chromatographic techniques, such as molecular sieve chromatography (gel filtration), such as Q-Sepharose® chromatography (chromatography utilizing an ion exchange chromatography resin with a quaternary amine (Q) functional group), ion exchange chromatography and hydrophobic chromatography, and with other usual techniques such as ultrafiltration, crystallization, salting-out, dialysis and native gel electrophoresis. Suitable methods are described for example in Cooper, T. G., Biochemische Arbeitsmethoden [Biochemical processes], Verlag Walter de Gruyter, Berlin, New York or in Scopes, R., Protein Purification, Springer Verlag, New York, Heidelberg, Berlin.

For isolating the recombinant protein, it can be advantageous to use vector systems or oligonucleotides, which lengthen the cDNA by defined nucleotide sequences and therefore code for altered polypeptides or fusion proteins, which for example serve for easier purification. Suitable modifications of this type are for example so-called "tags" functioning as anchors, for example the modification known as hexa-histidine anchor or epitopes that can be recognized as antigens of antibodies (described for example in Harlow, E. and Lane, D., 1988, Antibodies: A Laboratory Manual. Cold Spring Harbor (N.Y.) Press). These anchors can serve for attaching the proteins to a solid carrier, for example a polymer matrix, which can for example be used as packing in a chromatography column, or can be used on a microtiter plate or on some other carrier.

At the same time these anchors can also be used for recognition of the proteins. For recognition of the proteins, it is moreover also possible to use usual markers, such as fluorescent dyes, enzyme markers, which form a detectable reaction product after reaction with a substrate, or radioactive markers, alone or in combination with the anchors for derivatization of the proteins.

h. Polypeptide Immobilization

The enzymes or polypeptides according to the invention can be used free or immobilized in the method described herein. An immobilized enzyme is an enzyme that is fixed to an inert carrier. Suitable carrier materials and the enzymes immobilized thereon are known from EP-A-1149849, EP-A-1069183 and DE-OS 100193773 and from the references cited therein. Reference is made in this respect to the disclosure of these documents in their entirety. Suitable carrier materials include for example clays, clay minerals, such as kaolinite, diatomaceous earth, perlite, silica, aluminum oxide, sodium carbonate, calcium carbonate, cellulose powder, anion exchanger materials, synthetic polymers, such as polystyrene, acrylic resins, phenol formaldehyde resins, polyurethanes and polyolefins, such as polyethylene and polypropylene. For making the supported enzymes, the carrier materials are usually employed in a finely-divided, particulate form, porous forms being preferred. The particle size of the carrier material is usually not more than 5 mm, in particular not more than 2 mm (particle-size distribution curve). Similarly, when using dehydrogenase as whole-cell catalyst, a free or immobilized form can be selected. Carrier materials are e.g. Ca-alginate, and carrageenan. Enzymes as well as cells can also be crosslinked directly with glutaraldehyde (cross-linking to CLEAs). Corresponding and other immobilization techniques are described for example in J. Lalonde and A. Margolin "Immobilization of Enzymes" in K. Drauz and H. Waldmann, Enzyme Catalysis in Organic Synthesis 2002, Vol. III, 991-1032, Wiley-VCH, Weinheim. Further information on biotransformations and bioreactors for carrying out methods according to the invention are also given for example in Rehm et al. (Ed.) Biotechnology, 2nd Edn, Vol 3, Chapter 17, VCH, Weinheim.

i. Reaction Conditions for Biocatalytic Production Methods of the Invention

The reaction of the present invention may be performed under in vivo or in vitro conditions.

The at least one polypeptide/enzyme which is present during a method of the invention or an individual step of a multistep-method as defined herein above, can be present in living cells naturally or recombinantly producing the enzyme or enzymes, in harvested cells. i.e. under in vivo conditions, or, in dead cells, in permeabilized cells, in crude cell extracts, in purified extracts, or in essentially pure or completely pure form, i.e. under in vitro conditions. The at least one enzyme may be present in solution or as an enzyme immobilized on a carrier. One or several enzymes may simultaneously be present in soluble and/or immobilised form.

The methods according to the invention can be performed in common reactors, which are known to those skilled in the art, and in different ranges of scale, e.g. from a laboratory scale (few millilitres to dozens of litres of reaction volume) to an industrial scale (several litres to thousands of cubic meters of reaction volume). If the polypeptide is used in a form encapsulated by non-living, optionally permeabilized cells, in the form of a more or less purified cell extract or in purified form, a chemical reactor can be used. The chemical reactor usually allows controlling the amount of the at least one enzyme, the amount of the at least one substrate, the pH, the temperature and the circulation of the reaction medium. When the at least one polypeptide/enzyme is present in living cells, the process will be a fermentation. In this case the biocatalytic production will take place in a bioreactor (fermenter), where parameters necessary for suitable living conditions for the living cells (e.g. culture medium with nutrients, temperature, aeration, presence or absence of oxygen or other gases, antibiotics, and the like) can be controlled. Those skilled in the art are familiar with chemical reactors or bioreactors, e.g. with procedures for up-scaling chemical or biotechnological methods from laboratory scale to industrial scale, or for optimizing process parameters, which are also extensively described in the literature (for biotechnological methods see e.g. Crueger and Crueger, Biotechnologie—Lehrbuch der angewandten Mikrobiologie, 2. Ed., R. Oldenbourg Verlag, München, Wien, 1984).

Cells containing the at least one enzyme can be permeabilized by physical or mechanical means, such as ultrasound or radiofrequency pulses, French presses, or chemical means, such as hypotonic media, lytic enzymes and detergents present in the medium, or combination of such methods. Examples for detergents are digitonin, n-dodecylmaltoside, octylglycoside, Triton® X-100, Tween® 20, deoxycholate, CHAPS (3-[(3-Cholamidopropyl)dimethylammonio]-1-propansulfonate), Nonidet® P40 (Ethylphenolpoly(ethyleneglycolether), and the like.

Instead of living cells biomass of non-living cells containing the required biocatalyst(s) may be applied of the biotransformation reactions of the invention as well.

If the at least one enzyme is immobilised, it is attached to an inert carrier as described above.

The conversion reaction can be carried out batch wise, semi-batch wise or continuously. Reactants (and optionally nutrients) can be supplied at the start of reaction or can be supplied subsequently, either semi-continuously or continuously.

The reaction of the invention, depending on the particular reaction type, may be performed in an aqueous, aqueous-organic or non-aqueous reaction medium.

An aqueous or aqueous-organic medium may contain a suitable buffer in order to adjust the pH to a value in the range of 5 to 11, like 6 to 10.

In an aqueous-organic medium an organic solvent miscible, partly miscible or immiscible with water may be applied. Non-limiting examples of suitable organic solvents are listed below. Further examples are mono- or polyhydric, aromatic or aliphatic alcohols, in particular polyhydric aliphatic alcohols like glycerol.

The non-aqueous medium may contain is substantially free of water, i.e. will contain less that about 1 wt.-% or 0.5 wt.-% of water.

Biocatalytic methods may also be performed in an organic non-aqueous medium. As suitable organic solvents there may be mentioned aliphatic hydrocarbons having for example 5 to 8 carbon atoms, like pentane, cyclopentane, hexane, cyclohexane, heptane, octane or cyclooctane; aromatic carbohydrates, like benzene, toluene, xylenes, chlorobenzene or dichlorobenzene, aliphatic acyclic and ethers, like diethylether, methyl-tert-butylether, ethyl-tert.-butylether, dipropylether, diisopropylether, dibutylether; or mixtures thereof.

The concentration of the reactants/substrates may be adapted to the optimum reaction conditions, which may depend on the specific enzyme applied. For example, the initial substrate concentration may be in the 0.1 to 0.5 M, as for example 10 to 100 mM.

The reaction temperature may be adapted to the optimum reaction conditions, which may depend on the specific enzyme applied. For example, the reaction may be performed at a temperature in a range of from 0 to 70° C., as for example 20 to 50 or 25 to 40° C. Examples for reaction temperatures are about 30° C., about 35° C., about 37° C., about 40° C., about 45° C., about 50° C., about 55° C. and about 60° C.

The process may proceed until equilibrium between the substrate and then product(s) is achieved, but may be stopped earlier. Usual process times are in the range from 1 minute to 25 hours, in particular 10 min to 6 hours, as for example in the range from 1 hour to 4 hours, in particular 1.5 hours to 3.5 hours. These parameters are non-limiting examples of suitable process conditions.

If the host is a transgenic plant, optimal growth conditions can be provided, such as optimal light, water and nutrient conditions, for example.

k. Product Isolation and Derivatization

The methodology of the present invention can further include a step of recovering an end or intermediate product, optionally in stereoisomerically or enantiomerically substantially pure form. The term "recovering" includes extracting, harvesting, isolating or purifying the compound from culture or reaction media. Recovering the compound can be performed according to any conventional isolation or purification methodology known in the art including, but not limited to, treatment with a conventional resin (e.g., anion or cation exchange resin, non-ionic adsorption resin, etc.), treatment with a conventional adsorbent (e.g., activated charcoal, silicic acid, silica gel, cellulose, alumina, etc.), alteration of pH, solvent extraction (e.g., with a conventional solvent such as an alcohol, ethyl acetate, hexane and the like), distillation, dialysis, filtration, concentration, crystallization, recrystallization, pH adjustment, lyophilization and the like. Identity and purity of the isolated product may be determined by known techniques, like High Performance Liquid Chromatography (HPLC), gas chromatography (GC), Spektroskopy (like IR, UV, NMR), Colouring methods, TLC, NIRS, enzymatic or microbial assays. (see for example: Patek et al. (1994) Appl. Environ. Microbiol. 60:133-140; Malakhova et al. (1996) Biotekhnologiya 1127-32; und Schmidt et al. (1998) Bioprocess Engineer. 19:67-70. Ullmann's Encyclopedia of Industrial Chemistry (1996) Bd. A27, VCH: Weinheim, S. 89-90, S. 521-540, S. 540-547, S. 559-566, 575-581 und S. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Bd. 17.)

The unsaturated $C_{10}$ aldehydes compound produced in any of the method described herein can be converted to derivatives such as, but not limited to hydrocarbons, esters, amides, glycosides, ethers, epoxides, ketons, alcohols, diols, acetals or ketals. The unsaturated $C_{10}$ aldehyde derivatives can be obtained by a chemical method such as, but not limited to oxidation, reduction, alkylation, acylation and/or rearrangement. Alternatively, the unsaturated $C_{10}$ aldehyde derivatives can be obtained using a biochemical method by contacting the unsaturated $C_{10}$ aldehyde with an enzyme such as, but not limited to an oxidoreductase, a monooxygenase, a dioxygenase, a transferase. The biochemical conversion can be performed in-vitro using isolated enzymes, enzymes from lysed cells or in-vivo using whole cells.

1. Fermentative Production of Unsaturated $C_{10}$-Aldehydes

The invention also relates to methods for the fermentative production of unsaturated $C_{10}$ aldehydes.

A fermentation as used according to the present invention can, for example, be performed in stirred fermenters, bubble columns and loop reactors. A comprehensive overview of the possible method types including stirrer types and geometric designs can be found in "Chmiel: Bioprozesstechnik: Einführung in die Bioverfahrenstechnik, Band 1". In the process of the invention, typical variants available are the following variants known to those skilled in the art or explained, for example, in "Chmiel, Hammes and Bailey: Biochemical Engineering", such as batch, fed-batch, repeated fed-batch or else continuous fermentation with and without recycling of the biomass. Depending on the production strain, sparging with air, oxygen, carbon dioxide, hydrogen, nitrogen or appropriate gas mixtures may be effected in order to achieve good yield (YP/S).

The culture medium that is to be used must satisfy the requirements of the particular strains in an appropriate manner. Descriptions of culture media for various microorganisms are given in the handbook "Manual of Methods for General Bacteriology" of the American Society for Bacteriology (Washington D. C., USA, 1981).

These media that can be used according to the invention may comprise one or more sources of carbon, sources of nitrogen, inorganic salts, vitamins and/or trace elements.

Preferred sources of carbon are sugars, such as mono-, di- or polysaccharides. Very good sources of carbon are for example glucose, fructose, mannose, galactose, ribose, sorbose, ribulose, lactose, maltose, sucrose, raffinose, starch or cellulose. Sugars can also be added to the media via complex compounds, such as molasses, or other by-products from sugar refining. It may also be advantageous to add mixtures of various sources of carbon. Other possible sources of carbon are oils and fats such as soybean oil, sunflower oil, peanut oil and coconut oil, fatty acids such as palmitic acid, stearic acid or linoleic acid, alcohols such as glycerol, methanol or ethanol and organic acids such as acetic acid or lactic acid.

Sources of nitrogen are usually organic or inorganic nitrogen compounds or materials containing these compounds. Examples of sources of nitrogen include ammonia gas or ammonium salts, such as ammonium sulfate, ammonium chloride, ammonium phosphate, ammonium carbonate or ammonium nitrate, nitrates, urea, amino acids or complex sources of nitrogen, such as corn-steep liquor, soybean flour, soy-bean protein, yeast extract, meat extract and others. The sources of nitrogen can be used separately or as a mixture.

Inorganic salt compounds that may be present in the media comprise the chloride, phosphate or sulfate salts of calcium, magnesium, sodium, cobalt, molybdenum, potassium, manganese, zinc, copper and iron.

Inorganic sulfur-containing compounds, for example sulfates, sulfites, di-thionites, tetrathionates, thiosulfates, sulfides, but also organic sulfur compounds, such as mercaptans and thiols, can be used as sources of sulfur.

Phosphoric acid, potassium dihydrogenphosphate or dipotassium hydrogenphosphate or the corresponding sodium-containing salts can be used as sources of phosphorus.

Chelating agents can be added to the medium, in order to keep the metal ions in solution. Especially suitable chelating agents comprise dihydroxyphenols, such as catechol or protocatechuate, or organic acids, such as citric acid.

The fermentation media used according to the invention may also contain other growth factors, such as vitamins or growth promoters, which include for example biotin, riboflavin, thiamine, folic acid, nicotinic acid, pantothenate and pyridoxine. Growth factors and salts often come from complex components of the media, such as yeast extract, molasses, corn-steep liquor and the like. In addition, suitable precursors can be added to the culture medium. The precise composition of the compounds in the medium is strongly dependent on the particular experiment and must be decided individually for each specific case. Information on media optimization can be found in the textbook "Applied Microbiol. Physiology, A Practical Approach" (1997) Growing media can also be obtained from commercial suppliers, such as Standard 1 (Merck) or BHI (Brain heart infusion, DIFCO) etc.

All components of the medium are sterilized, either by heating (20 min at 1.5 bar and 121° C.) or by sterile filtration. The components can be sterilized either together, or if necessary separately. All the components of the medium can be present at the start of growing, or optionally can be added continuously or by batch feed.

The temperature of the culture is normally between 15° C. and 45° C., preferably 25° C. to 40° C. and can be kept constant or can be varied during the experiment. The pH value of the medium should be in the range from 5 to 8.5, preferably around 7.0. The pH value for growing can be controlled during growing by adding basic compounds such as sodium hydroxide, potassium hydroxide, ammonia or ammonia water or acid compounds such as phosphoric acid or sulfuric acid. Antifoaming agents, e.g. fatty acid polyglycol esters, can be used for controlling foaming. To maintain the stability of plasmids, suitable substances with selective action, e.g. antibiotics, can be added to the medium. Oxygen or oxygen-containing gas mixtures, e.g. the ambient air, are fed into the culture in order to maintain aerobic conditions. The temperature of the culture is normally from 20° C. to 45° C. Culture is continued until a maximum of the desired product has formed. This is normally achieved within 1 hour to 160 hours.

The methodology of the present invention can further include a step of recovering said one or more unsaturated $C_{10}$ aldehydes.

The term "recovering" includes extracting, harvesting, isolating or purifying the compound from culture media. Recovering the compound can be performed according to any conventional isolation or purification methodology known in the art including, but not limited to, treatment with a conventional resin (e.g., anion or cation exchange resin, non-ionic adsorption resin, etc.), treatment with a conventional adsorbent (e.g., activated charcoal, silicic acid, silica gel, cellulose, alumina, etc.), alteration of pH, solvent extraction (e.g., with a conventional solvent such as an alcohol, ethyl acetate, hexane and the like), distillation, dialysis, filtration, concentration, crystallization, recrystallization, pH adjustment, lyophilization and the like.

Before the intended isolation the biomass of the broth can be removed. Processes for removing the biomass are known to those skilled in the art, for example filtration, sedimentation and flotation. Consequently, the biomass can be removed, for example, with centrifuges, separators, decanters, filters or in flotation apparatus. For maximum recovery of the product of value, washing of the biomass is often advisable, for example in the form of a diafiltration. The selection of the method is dependent upon the biomass content in the fermenter broth and the properties of the biomass, and also the interaction of the biomass with the product of value.

In one embodiment, the fermentation broth can be sterilized or pasteurized. In a further embodiment, the fermentation broth is concentrated. Depending on the requirement, this concentration can be done batch wise or continuously. The pressure and temperature range should be selected such that firstly no product damage occurs, and secondly minimal use of apparatus and energy is necessary. The skillful selection of pressure and temperature levels for a multistage evaporation in particular enables saving of energy.

The following examples are illustrative only and are not meant to limit the scope of invention as set forth in the Summary, Description or in the Claims.

The numerous possible variations that will become immediately evident to a person skilled in the art after heaving considered the disclosure provided herein also fall within the scope of the invention.

EXPERIMENTAL PART

Materials:

Unless otherwise stated, all chemical and biochemical materials and microorganisms or cells employed herein are commercially available products.

Unless otherwise specified, recombinant proteins are cloned and expressed by standard methods, such as, for example, as described by Sambrook, J., Fritsch, E. F. and Maniatis, T., Molecular cloning: A Laboratory Manual, 2nd Edition, Cold Spring Harbor Laboratory, Cold Spring Harbor Laboratory Press, Cold Spring Harbor, NY, 1989.

Methods:

Functional Expression of Lipoxygenase

The coding sequences of lipoxygenase (LOX) were optimized by following the genetic codon frequency of *E. coli*, synthesized and then subcloned into the pETDuet-1 (Novagen, Merck KGaA, Germany) plasmid for subsequent expression in *E. coli*. BL21 *E. coli* cells (Tiangen, China) were transformed with the plasmids pETDuet-LOX. The transformed cells were selected on LB-agar plates containing Ampicillin (50 μg/mL final). Single colonies were used to inoculate 25 mL liquid LB medium containing Ampicillin (50 μg/mL final). Cultures were incubated at 37° C. and 200 rpm shaking. After 4 hours incubation, the cultures were cooled down to 20° C. for 1.5 hour and IPTG (0.016 mM final) was added to induce protein expression. To express proteins the cultures were incubated for another 16 hours at 20° C. and 200 rpm shaking. The cultures were spin down and resuspended in 3 mL of reaction buffer (25 mM Tris-HCl pH7.5) followed by a sonication process to make protein solution, respectively. The protein solution was transferred into a 20 mL SPME vial, 30 μL fatty acid substrate and 10 μL internal standard (80 ppm alpha-ionone in ethanol) were added into the vial. After 10 min incubation, the SPME-GC-MS method described below was used for analysis of decadienals and decatrienals.

Solid Phase Micro Extraction Gas Chromatography Mass Spectrometry (SPME-GC-MS)

The reaction mixture was concentrated on a solid phase microextraction (SPME) fiber assembly polydimethylsiloxane/carboxen/divinylbenzene (57329-U, SUPELCO). The extraction was performed in headspace mode at 40° C. for 20 min. After extraction, the SPME fiber was introduced into the GC-MS inlet and maintained at 250° C. for 5 min, and the products were analyzed on an Agilent 6890 series GC system equipped with a DB1-ms column 30 m×0.25 mm×0.25 μm film thickness (P/N 122-0132, J&W scientific Inc., Folsom, CA) and coupled with a 5975 series mass spectrometer (Agilent, US). The carrier gas was helium at a constant flow of 0.7 mL/min. Injection was in splitless mode with the injector temperature set at 250° C. The oven temperature was programmed from 50° C. (5 min hold) to 250° C. at 15° C./min (5 min hold). Identification of products was based on mass spectra and retention indices as well as respective product standards.

Liquid Chromatography Coupled to UV Detection and Mass Spectrometry (LC-UV/MS)

200 μL of reaction mixture was diluted with 800 μL acetonitrile and then put on ice for 30 min. Filtration with 0.2 μL regenerated cellulose membrane (5190-5108, Agilent) was applied to remove the protein precipitation from the mixture. 1 μL of sample was injected to LC for the quantification of decadienal as well as side products.

Part A

UfLOX Isolation and Characterization

Example 1: Seaweed Sourcing and Analysis for Aroma Aldehydes

Plant materials of *Ulva fasciata* (sample ID: PA-2017-0012) were collected from Nanao, Guangdong Province, China. One gram of smashed sample was put into a 20 mL vial for further SPME-GC-MS analysis.

To determine whether *U. fasciata* contained decadienals or decatrienals, fresh samples were analyzed by SPME-GC-MS as described in the Methods section.

One gram of smashed *U. fasciata* sample was put into a 20 mL vial with 3 mL Tris-HCl buffer (pH=7.5). 30 μL fatty acid substrate (30 μL LA, ALA, GLA, EPA, ARA, borage oil hydrolysate, arachidonic oil hydrolysate, linseed oil hydrolysate or fish oil hydrolysate in 1 ml ethanol respectively) and 10 μL internal standard (80 ppm alpha-ionone in ethanol) were added into the vial for incubation. After 10 min incubation at RT, the SPME-GC-MS method described in the method section was used for analysis of decadienals and decatrienals.

Figure 2:
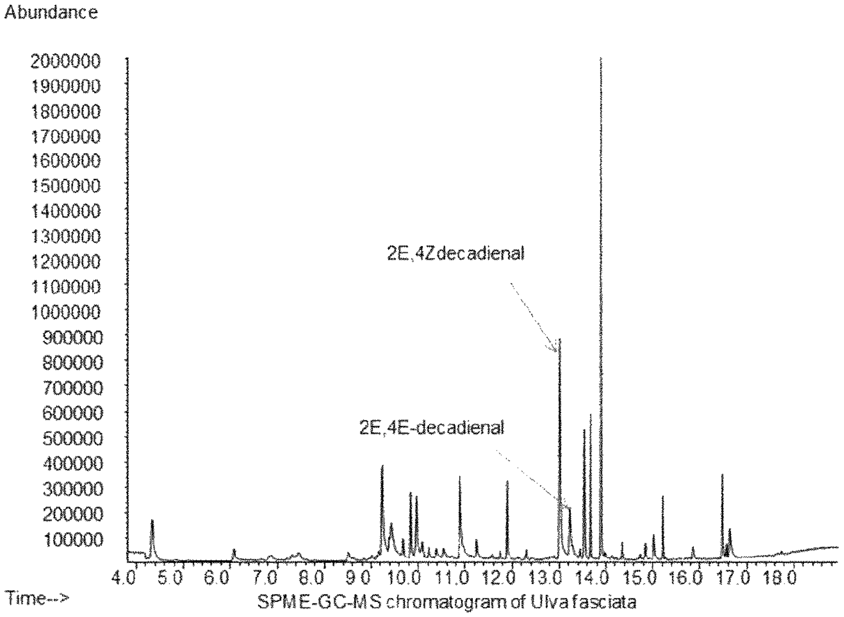
FIG. 2. SPME/GC/MS chromatogram of fresh samples of *U. fasciata.*
Figure 3:
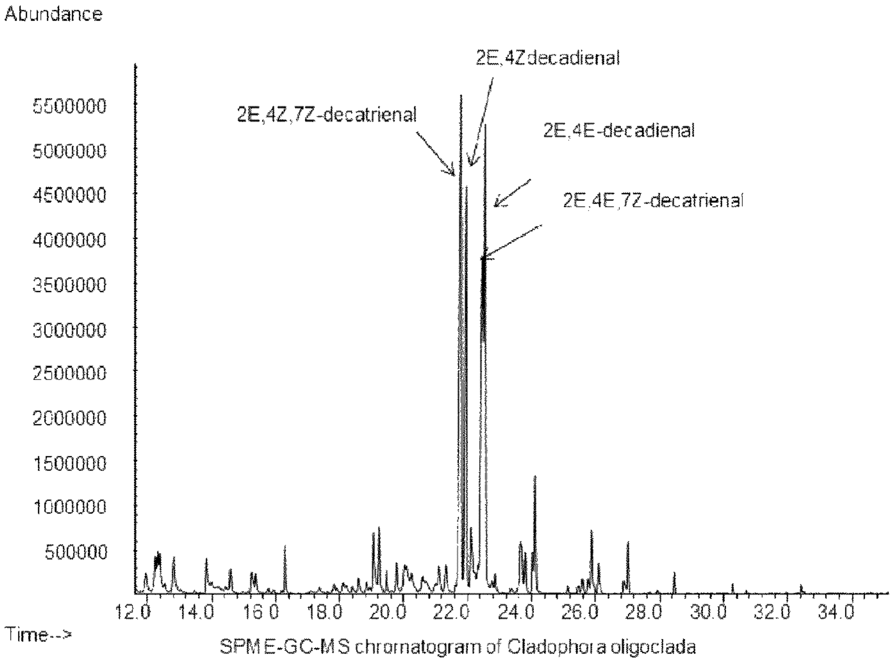
FIG. 3. SPME/GC/MS chromatogram of fresh samples of *C. oligoclara.*
Figure 4:
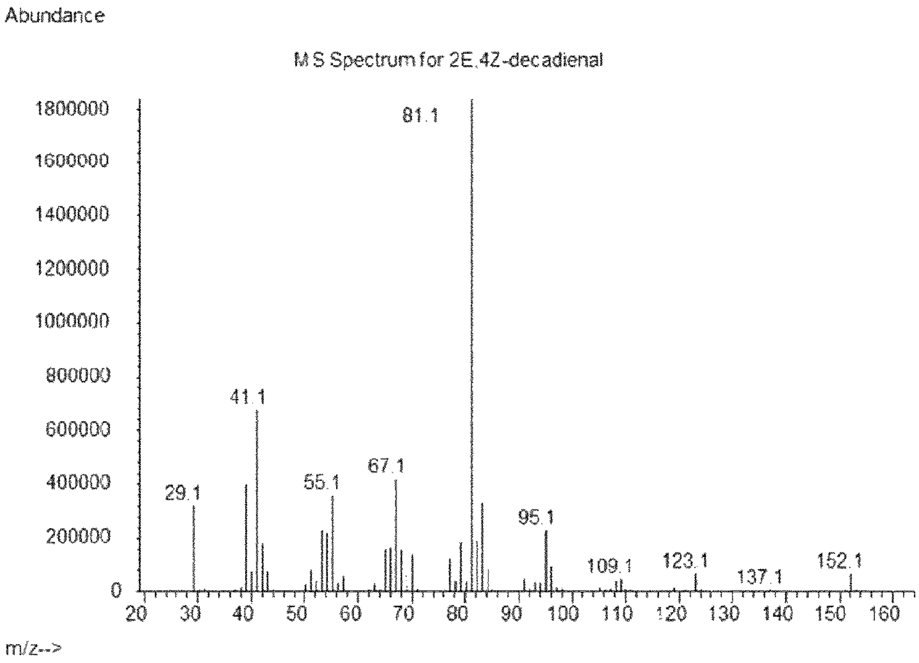
FIG. 4. MS spectrum of 2E,4Z-decadienal.
Figure 5:
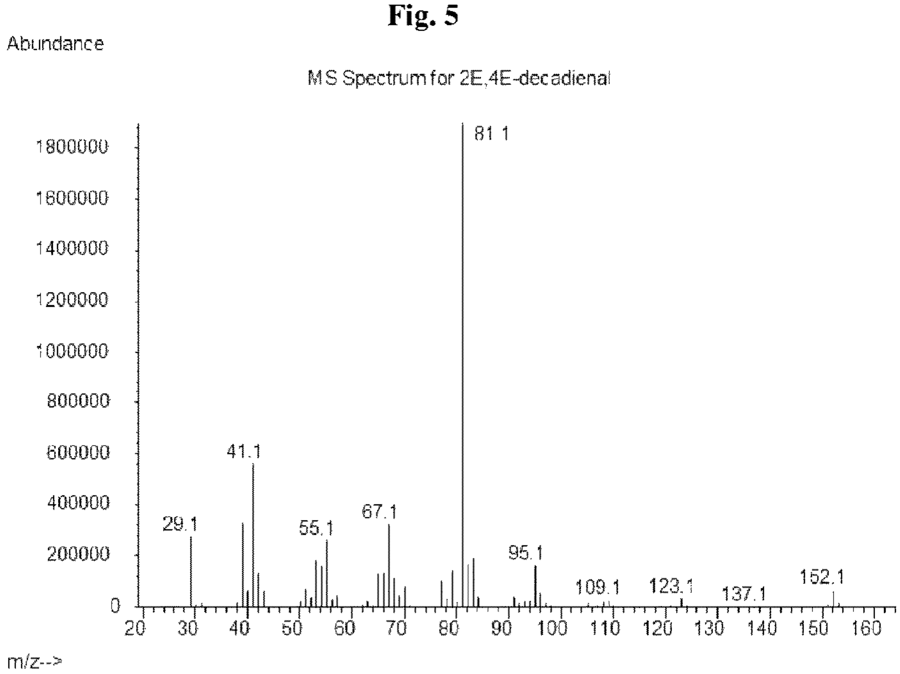
FIG. 5. MS spectrum of 2E,4E-decadienal.
Figure 6:
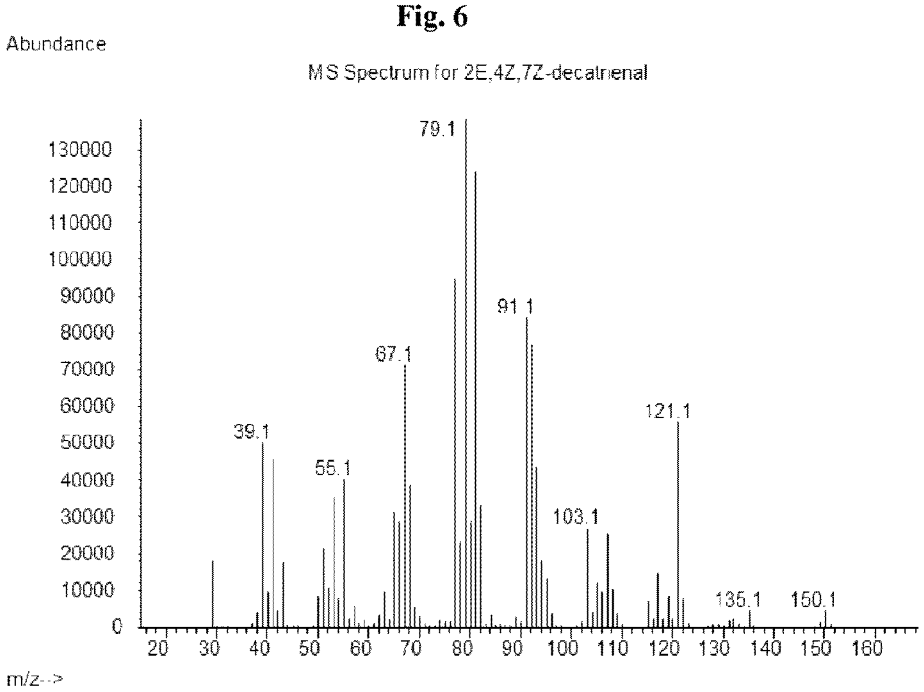
FIG. 6. MS spectrum of 2E,4Z,7Z-decatrienal.
Figure 7:
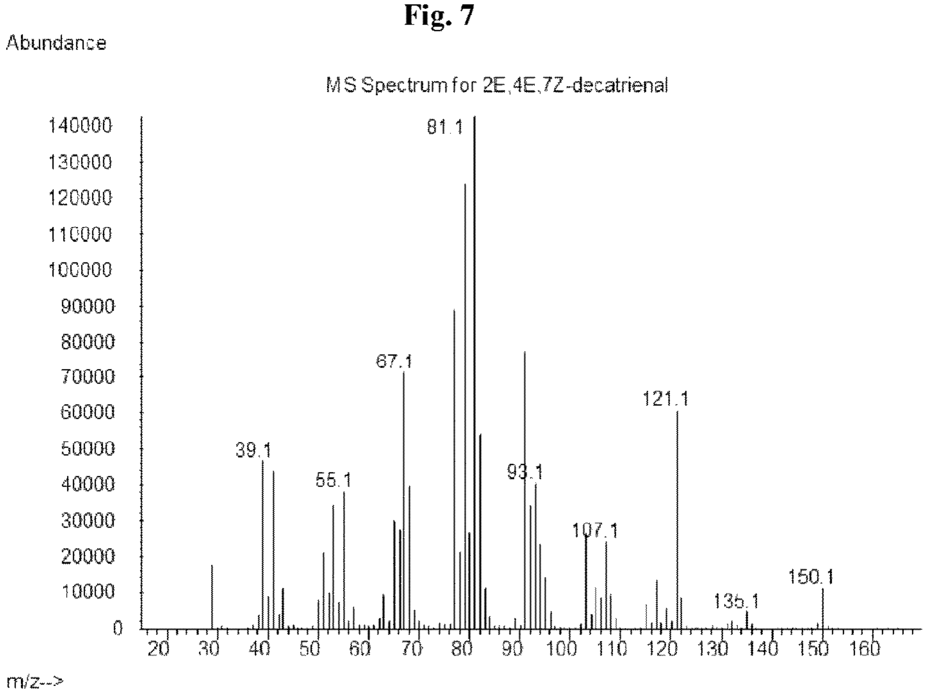
FIG. 7. MS spectrum of 2E,4E,7Z-decatrienal.

GC-MS analysis revealed that there were limited amounts of 2E,4Z-decadienal (retention time 13.0 min) and 2E,4E-decadienal (retention time 13.25 min) (FIGS. 2, 4 and 5) in *U. fasciata*, however, after feeding with gamma-linolenic acid, the content thereof increased significantly (Table 1).

TABLE 1

SPME-GC-MS analysis for *U. fasciata* before and after feeding with gamma linolenic acid (GLA)

| components | Retention time | % Abundance based on peak area in *U. fasciata* | % Abundance based on peak area after feeding *U. fasciata* with GLA |
|---|---|---|---|
| 2E,4Z-decadienal | 13.0 min | 15.5% | 40.8% |
| 2E,4E-decadienal | 13.25 min | 5.2% | 13.6% |

Example 2: Transcriptome Analysis and Identification of UfLOX Protein

Total RNA of *U. fasciata* was extracted using the RNeasy Plant Mini Kit (Qiagen, Germany). The total RNA sample was processed using NEBNext® Ultra™ RNA Library Prep Kit for Illumina (NEB, USA) and TruSeq PE Cluster Kit (Illumina, USA) and then sequenced on Illumina HiSeq 2500 System. An amount of 38 million of paired-end reads of 2×150 bp was generated. The reads were processed using the Trinity (http://trinityrnaseq.sf.net/) software and 91564 transcripts with an N50 of 2262 were obtained. The obtained transcripts were translated into protein sequences and then functionally annotated by searching the NCBI non-redundant protein sequence database using the tblastx algorithm. One candidate protein sequence of LOX was mined by Pfam search and relative expression level.

The total RNA sample of *U. fasciata* was first reverse transcribed into cDNA using SMARTer™ RACE cDNA Amplification Kit (Clontech, Takara, Japan). The products were then used as the template for gene cloning. The coding sequence of UfLOX2 (SEQ ID NO:18) was amplified from the cDNA by using forward primer (5'-TCGTCCAACAGGTTCTCTT-3') (SEQ ID NO:57) and reverse primer (5'-TTCTTTCCACTCACCGCCA-3') (SEQ ID NO:58).

Example 3: Functional Characterization of UfLOX2

The coding sequence of UfLOX2 was optimized by following the genetic codon frequency of *E. coli*, synthesized and then subcloned into the pETDuet-1 plasmid for subsequent expression in *E. coli*. The following codon optimized sequences were applied: UfLOX2 (SEQ ID NO:17) and plasmid pETDuet-UfLOX2 was obtained.

Functional expression of the gene was performed as described above in the Methods section to yield protein solution. The enzymatic activity of the UfLOX2 was evaluated as described below:

a) UfLOX2 (SEQ ID NO:18) was tested by feeding with fatty acid substrate including gamma-linolenic acid (GLA), 9eb alpha-linolenic acid (ALA), linoleic acid (LA) and arachidonic acid (ARA) as below:

The protein solution (3 mL) from *E. coli* which contain UfLOX2 was put into a 20 mL SPME vial, 30 μL fatty acid substrate (30 μL LA, ALA, GLA, EPA, ARA, borage oil, arachidonic oil, linseed oil or fish oil in 1 mL ethanol respectively) and 10 μL internal standard (80 ppm alpha-ionone in ethanol) were added into the vial for incubation. After 10 min at RT, the SPME-GC-MS method described in the method section was used for analysis of decadienals and decatrienals.

UfLOX2 showed capability to produce decadienals (retention time 12.60 and 12.80 min) when feeding with specific substrates (Table 2)

TABLE 2

SPME-GC-MS analysis for UfLOX2 before and after feeding with GLA and arachidonic acid (ARA)

| Components | Retention time | % Abundance based on peak area in UfLOX2 control | % Abundance based on peak area after feeding UfLOX2 with GLA | % Abundance based on peak area after feeding UfLOX2 with ARA |
|---|---|---|---|---|
| 2E,4Z-decadienal | 12.6 min | 0% | 58.0% | 56.7% |
| 2E,4E-decadienal | 12.8 min | 0% | 27.0% | 38.3% |

b) To prove the lyase activity for UfLOX2, feeding experiments with fatty acid hydroperoxide was performed.

To test the HPL activity, UfLOX2 was produced in *E. coli* and cell lysates that contain UfLOX2 were prepared for testing its HPL activity. One aliquot of UfLOX2 was feed with GLA as a positive control of making decadienal. A second and third aliquot of UfLOX2 was denatured (boiled at 100° C. for 20 min) and feed with GLA or GLA hydroperoxide (GLA-HPO) as negative control to exclude UfLOX2 functionality to make decadienal and to show the conversion of GLA-HPO to decadienal in a non-UfLOX2 manner, respectively. A fourth aliquot of UfLOX2 was feed with GLA hydroperoxide (GLA-HPO) to prove its HPL activity in comparison with the third aliquot (i.e. non-UfLOX2 conversion of GLA-HPO to decadienal). In addition, the buffer for making UfLOX2 aliquots was also set as a negative control to show the non-UfLOX2 conversion of GLA-HPO to decadienal.

To prepare the GLA hydroperoxide (GLA-HPO) intermediate, 50 mL of UfLOX2 protein solution was incubated with 0.5 mL GLA (60 mg/mL) and stored at room temperature for 10 min. The reaction mixture was then loaded on a HLB column (Waters. US Part No. 186000118). The column was eluted with 10 mL of methanol to get GLA-HPO. After incubation for 1 hour, the reaction mixture was checked with LC-MS.

The results are summarized in Table 3 below.

TABLE 3

Decadienal peak areas by feeding heat-treated or non-treated UfLOX2 with gamma linolenic hydroperoxide intermediate

| | LOX + GLA | Denatured LOX + GLA | LOX + GLA-HPO | Denatured LOX + GLA-HPO | Buffer + GLA-HPO |
|---|---|---|---|---|---|
| E,Z-decadienal | 34.5 ± 4.2 | trace | 86.6 ± 15.1 | 7.97 ± 1 | 34 ± 2.8 |
| E,E-decadienal | 178 ± 8 | trace | 222 ± 20.8 | 35.0 ± 0.8 | 17.2 ± 1.1 |

Part B

CoLOX Isolation and Characterization

Example 4: Seaweed Sourcing and Analysis for Aroma Aldehydes

Plant materials of *Cladophora oligoclada* (sample ID: AVLH2012-011) were collected from Qingdao, Shandong Province, China. One gram of smashed sample was put into a 20 mL vial for further SPME-GC-MS analysis.

Identification of peaks was based on comparison of their mass spectra and retention indices with those in internal libraries. GC-MS analysis revealed four main components in *C. oligoclada* as showed in Table 4 and FIG. 3-7:

TABLE 4

Identified flavor aldehydes from *C. oligoclada*

| Components | Retention time | % Peak area |
|---|---|---|
| 2E,4Z-decadienal | 22.0 min | 12.1% |
| 2E,4E-decadienal | 22.6 min | 11.9% |
| 2E,4Z,7Z-decatrienal | 21.8 min | 21.7% |
| 2E,4E,7Z-decatrienal | 22.5 min | 12.2% |

Example 5: Transcriptome Analysis and Identification of CoLOX Proteins

Fresh sample from *C. oligoclada* was extracted by MiniBest plant RNA extraction kit to yield total RNA by following protocol I provided by the kit (Cat. #9769 v201309 Da, Takara, Japan). The total RNA sample was processed using the TruSeq PE Cluster Kit (Illumina, USA) and then sequenced on an Illumina MiSeq System. An amount of 14 million of paired-end reads of 2×251 bp was generated. The reads were processed using the Trinity (http://trinityrnaseq.sf.net/) software and 225917 transcripts with an N50 of 676 were obtained. The obtained transcripts were translated into protein sequences and then functionally annotated by searching the NCBI non-redundant protein sequence database using the tblastx algorithm. One candidate protein sequence of LOX was mined by Pfam search and relative expression level.

The total RNA sample *C. oligoclada* (sample ID: PA-2017-0028) was first reverse transcribed into cDNA using SMARTer™ RACE cDNA Amplification Kit (Clontech Takara, Japan). The products were then used as the template for gene cloning. By using forward primer (5'-CTCTCTCTCTTTCTCTCTGTTCT-3') (SEQ ID NO:55) and reverse primer (5'-CTCGTTCCCTTACCGTCT-3') (SEQ ID NO:56) several coding sequences of LOX were amplified from the cDNA, designated CoLOX-3 (SEQ ID NO:3) (and its variants) CoLOX-0317 (SEQ ID NO:6), CoLOX-19 (SEQ ID NO:9), CoLOX-22 (SEQ ID NO:12) and CoLOX-d4 (SEQ ID NO:15).

Example 6: Functional Characterization of CoLOX Proteins

The nucleic acid sequences of CoLOX-3 and its variants CoLOX-0317, CoLOX-19, CoLOX-22 and CoLOX-d4 were codon optimized by following the genetic codon frequency of *E. coli*, synthesized and then subcloned into the pETDuet-1 (Novagen, Merck KGaA, Germany) between NdeI and KpnI sites, respectively, for subsequent expression in *E. coli*. The following codon optimized sequences were applied: CoLOX-3 (SEQ ID NO:2), CoLOX-0317 (SEQ ID NO:5), CoLOX-19 (SEQ ID NO:8), CoLOX-22 (SEQ ID NO:11) and CoLOX-d4 (SEQ ID NO:14), and the following plasmids were prepared: pETDuet-CoLOX-3, pETDuet-CoLOX-0317, pETDuet-CoLOX-19, pETDuet-CoLOX-22 and pETDuet-CoLOX-d4. Functional expression of the genes was performed as described above in the Methods section. The cultures were spin down and resuspended in 3 mL of buffer (25 mM Tris-HCl pH7.5, 0.2 mM $CaCl_2$) followed by a sonication step to make the respective protein solution.

The crude protein solutions (3 mL) of CoLOX-3, CoLOX-0317, CoLOX-19, CoLOX-22 and CoLOX-d4 were put into a 20 mL SPME vial, respectively, 30 μL fatty acid substrate (30 μL LA, ALA, GLA, EPA, ARA borage oil, arachidonic oil, linseed oil or fish oil in 1 ml ethanol respectively) and 10 μL internal standard (80 ppm alpha-ionone in ethanol) were added into each of the vial for incubation. After 10 min at RT, the SPME-GC-MS method described in the methods section was used for analysis of decadienals and decatrienals. A mixture of buffer plus fatty acid plus internal standard was used as control.

Figure 8:
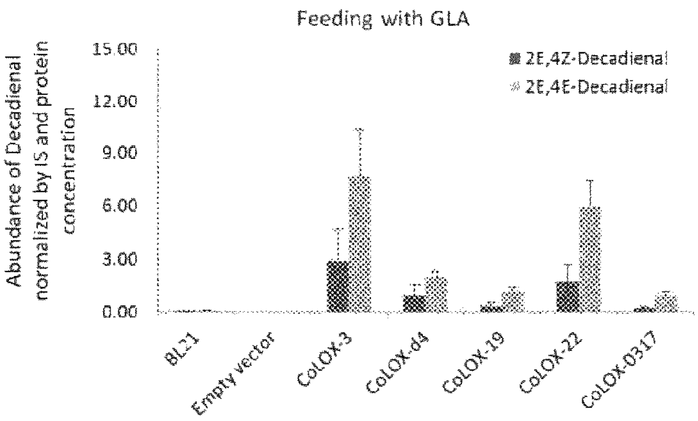
FIG. 8. Feeding results of CoLOXs of the present invention with gamma-acid; in comparison with negative controls (BL21=non-transformed *E. coli* cells; pETDuet=BL21 transformed with empty vector)
Figure 9:
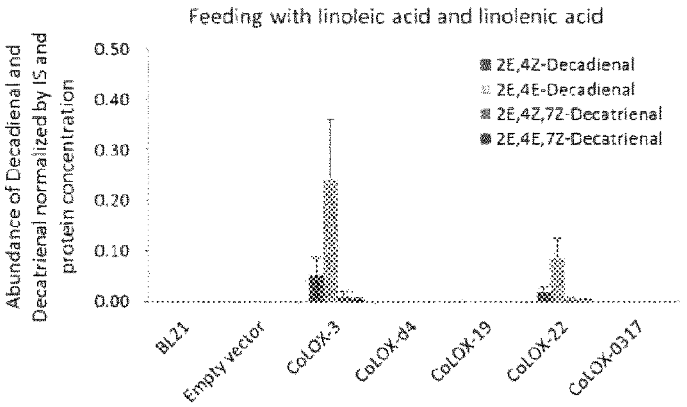
FIG. 9. Feeding result of CoLOXs of the present invention with alpha-linolenic acid and linoleic acid mixture in comparison with negative controls (BL21=non-transformed *E. coli* cells; Empty vector=pETDuet-1 transformed *E. coli* cells)
Figure 10:
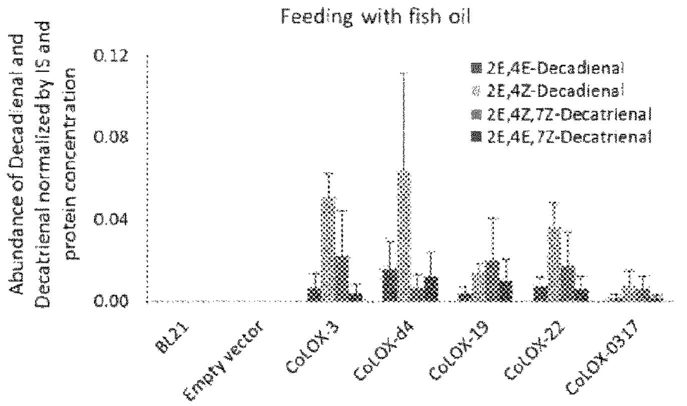
FIG. 10. Feeding result of CoLOXs of the present invention with fish oil in comparison with negative controls (BL21=non-transformed *E. coli* cells; Empty vector=pETDuet-1 transformed *E. coli* cells)

All five proteins showed capability to produce decadienals and/or decatrienals when feeding with specific substrates (see Table 5 and 6 below and FIGS. 8, 9 and 10).

TABLE 5

Decadienals/internal standard peak ratio after feeding with GLA (normalized by protein concentration)

| | Ratio for 2E,4Z-decadienal | Ratio for 2E,4E-decadienal |
|---|---|---|
| BL21 | 0.023 ± 0.023 | 0.049 ± 0.049 |
| Empty vector | 0.000 ± 0.000 | 0.000 ± 0.000 |
| CoLOX-3 | 2.866 ± 1.824 | 7.712 ± 2.633 |
| CoLOX-d4 | 0.917 ± 0.631 | 1.931 ± 0.329 |
| CoLOX-19 | 0.340 ± 0.200 | 1.113 ± 0.325 |
| CoLOX-22 | 1.729 ± 0.933 | 6.019 ± 1.422 |
| CoLOX-0317 | 0.207 ± 0.096 | 0.888 ± 0.262 |

TABLE 6

Decadienals/internal standard peak ratio after feeding with fish oil hydrolysate (normalized by protein concentration)

| | Ratio for 2E,4Z-decadienal | Ratio for 2E,4E-decadienal | Ratio for 2E,4Z,7Z-decatrienal | Ratio for 2E,4E,7Z-decatrienal |
|---|---|---|---|---|
| BL21 | 0.000 ± 0.000 | 0.000 ± 0.000 | 0.000 ± 0.000 | 0.000 ± 0.000 |
| Empty vector | 0.000 ± 0.000 | 0.000 ± 0.000 | 0.000 ± 0.000 | 0.000 ± 0.000 |
| CoLOX-3 | 0.007 ± 0.007 | 0.051 ± 0.012 | 0.022 ± 0.022 | 0.004 ± 0.004 |
| CoLOX-d4 | 0.016 ± 0.014 | 0.064 ± 0.048 | 0.007 ± 0.007 | 0.012 ± 0.012 |
| CoLOX-19 | 0.004 ± 0.003 | 0.014 ± 0.005 | 0.020 ± 0.020 | 0.010 ± 0.010 |

TABLE 6-continued

| Decadienals/internal standard peak ratio after feeding with fish oil hydrolysate (normalized by protein concentration) | | | | |
|---|---|---|---|---|
| | Ratio for 2E,4Z-decadienal | Ratio for 2E,4E-decadienal | Ratio for 2E,4Z,7Z-decatrienal | Ratio for 2E,4E,7Z-decatrienal |
| CoLOX-22 | 0.007 ± 0.005 | 0.036 ± 0.012 | 0.017 ± 0.017 | 0.006 ± 0.006 |
| CoLOX-0317 | 0.002 ± 0.002 | 0.008 ± 0.008 | 0.006 ± 0.006 | 0.002 ± 0.002 |

Part C

Mining and Characterization of $C_{10}$-Aldehyde-Producing LOXs from Public Database

Example 7: Mining and Selection of LOXs by Sequence Analysis

Due to its activity of producing decadienals and decatrienals, UfLOX2 was used to search for more LOXs from GenBank by using BLASTP 2.8.0+ (https://blast.ncbi.nlm.nih.gov/Blast.cgi). A total of 188 LOXs were found by this approach, in which 181 LOXs are from cyanobacteria, 5 LOXs are from proteobacteria, and 2 LOXs are from planctomycetes, with sequence identity of less than 42% to UfLOX2. 16 LOXs were selected as example for a relatively higher sequence identity to UfLOX2 and being representative for their own homologs, as listed in Table 7. Two known LOXs from red algae were listed and used for comparison. The residual 83 LOXs with a relatively higher identity to UfLOX2 were listed in the attached sequence listing as SEQ ID NO: 75 to 239 (amino acid and nucleic acid sequences. The start codons, where necessary, were set as ATG.

TABLE 7

| List of bifunctional LOXs | | |
|---|---|---|
| Protein ID | Species | Group |
| UfLOX2[b] | *Ulva fasciata* | Green alga |
| CoLOX-3[a] | *Cladophora oligoclada* | Green alga |
| AFQ59981.1[c] | *Pyropia haitanensis* | Red alga |
| AGN54275.1[d] | *Pyropia haitanensis* | Red alga |

TABLE 7-continued

| List of bifunctional LOXs | | |
|---|---|---|
| Protein ID | Species | Group |
| WP_002738122.1 | *Microcystis aeruginosa* | Cyanobacteria |
| WP_006635899.1 | *Microcoleus vaginatus* | Cyanobacteria |
| WP_015178512.1 | *Oscillatoria nigro-viridis* | Cyanobacteria |
| WP_015204462.1 | *Crinalium epipsammum* | Cyanobacteria |
| WP_028091425.1 | *Dolichospermum circinale* | Cyanobacteria |
| OBQ25779.1 | *Aphanizomenon flos-aquae* LD13 | Cyanobacteria |
| OBQ01436.1 | *Anabaena* sp. AL09 | Cyanobacteria |
| WP_039200563.1 | *Aphanizomenon flos-aquae* | Cyanobacteria |
| WP_012407347.1 | *Nostoc punctiforme* | Cyanobacteria |
| WP_096647440.1 | *Calothrix brevissima* | Cyanobacteria |
| WP_027843955.1 | *Mastigocoleus testarum* | Cyanobacteria |
| WP_073641301.1 | *Nostoc calcicola* | Cyanobacteria |
| WP_052672367.1 | *Aliterella atlantica* | Cyanobacteria |
| WP_073631249.1 | *Scytonema* sp. HK-05 | Cyanobacteria |
| WP_099099431.1 | *Nostoc* sp. '*Peltigera malacea cyanobiont*' DB3992 | Cyanobacteria |
| WP_013220336.1 | *Nitrosococcus watsonii* | Proteobacteria |

Note:
[a]CoLOX-3 of present invention;
[b]UfLOX2 of present invention;
[c]AFQ59981.1 (PhLOX) was described for example by Jechan Lee et al., Environmental Pollution 227 (2017) 252-262;
[d]AGN54275.1 (PhLOX2) was described in Zhujun Zhu et al., PLoS One. (2015) 10(2): e0117351.

The amino acid sequence identity and the number of different residues are summarized in Table 8. The upper right block shows the number of unmatched amino acids, the lower left block shows the sequence identity. The sequence identities between the bacterial LOXs and UfLOX2 range from 32 to 42%. The sequence identities between the bacterial LOXs and CoLOX-3 range from 13 to 16%. The sequence identities between the bacterial LOXs and the red algae LOXs are less than 15%.

TABLE 8

| The sequence identity of the LOXs. | | | | | |
|---|---|---|---|---|---|
| | WP_002738122.1 | WP_006635899.1 | WP_015178512.1 | WP_015204462.1 | WP_028091425.1 |
| WP_002738122.1 | ID | 223 | 218 | 232 | 298 |
| WP_006635899.1 | 0.623 | ID | 58 | 266 | 271 |
| WP_015178512.1 | 0.631 | 0.898 | ID | 266 | 276 |
| WP_015204462.1 | 0.641 | 0.588 | 0.588 | ID | 352 |
| WP_028091425.1 | 0.497 | 0.531 | 0.522 | 0.451 | ID |
| OBQ01436.1 | 0.495 | 0.527 | 0.519 | 0.453 | 0.961 |
| OBQ25779.1 | 0.5 | 0.531 | 0.522 | 0.451 | 0.963 |
| WP_039200563.1 | 0.504 | 0.532 | 0.531 | 0.467 | 0.875 |
| WP_012407347.1 | 0.495 | 0.555 | 0.562 | 0.471 | 0.726 |
| WP_027843955.1 | 0.495 | 0.537 | 0.541 | 0.464 | 0.615 |
| WP_073641301.1 | 0.51 | 0.56 | 0.56 | 0.493 | 0.717 |
| WP_096647440.1 | 0.497 | 0.56 | 0.57 | 0.487 | 0.72 |
| WP_099099431.1 | 0.427 | 0.448 | 0.446 | 0.412 | 0.508 |
| WP_052672367.1 | 0.415 | 0.43 | 0.436 | 0.408 | 0.481 |
| WP_073631249.1 | 0.436 | 0.472 | 0.465 | 0.417 | 0.513 |

TABLE 8-continued

The sequence identity of the LOXs.

| | | | | | |
|---|---|---|---|---|---|
| WP_013220336.1 | 0.405 | 0.437 | 0.43 | 0.377 | 0.507 |
| UfLOX2 | 0.417 | 0.406 | 0.406 | 0.406 | 0.364 |
| CoLOX-3 | 0.149 | 0.149 | 0.149 | 0.144 | 0.157 |
| AFQ59981.1 | 0.133 | 0.139 | 0.141 | 0.129 | 0.148 |
| AGN54275.1 | 0.133 | 0.129 | 0.133 | 0.131 | 0.136 |

| | OBQ01436.1 | OBQ25779.1 | WP_039200563.1 | WP_012407347.1 | WP_027843955.1 |
|---|---|---|---|---|---|
| WP_002738122.1 | 299 | 296 | 294 | 299 | 302 |
| WP_006635899.1 | 273 | 272 | 270 | 257 | 270 |
| WP_015178512.1 | 278 | 277 | 271 | 253 | 268 |
| WP_015204462.1 | 351 | 354 | 342 | 339 | 347 |
| WP_028091425.1 | 21 | 20 | 68 | 150 | 213 |
| OBQ01436.1 | ID | 15 | 65 | 149 | 211 |
| OBQ25779.1 | 0.972 | ID | 66 | 151 | 214 |
| WP_039200563.1 | 0.881 | 0.88 | ID | 150 | 221 |
| WP_012407347.1 | 0.728 | 0.726 | 0.726 | ID | 209 |
| WP_027843955.1 | 0.619 | 0.616 | 0.6 | 0.622 | ID |
| WP_073641301.1 | 0.717 | 0.719 | 0.724 | 0.862 | 0.632 |
| WP_096647440.1 | 0.722 | 0.722 | 0.735 | 0.893 | 0.613 |
| WP_099099431.1 | 0.504 | 0.504 | 0.5 | 0.521 | 0.502 |
| WP_052672367.1 | 0.478 | 0.48 | 0.477 | 0.502 | 0.48 |
| WP_073631249.1 | 0.519 | 0.517 | 0.514 | 0.55 | 0.513 |
| WP_013220336.1 | 0.505 | 0.5 | 0.497 | 0.499 | 0.474 |
| UfLOX2 | 0.362 | 0.36 | 0.364 | 0.352 | 0.357 |
| CoLOX-3 | 0.157 | 0.158 | 0.157 | 0.143 | 0.148 |
| AFQ59981.1 | 0.145 | 0.146 | 0.143 | 0.135 | 0.135 |
| AGN54275.1 | 0.135 | 0.135 | 0.132 | 0.134 | 0.135 |

| | WP_073641301.1 | WP_096647440.1 | WP_099099431.1 | WP_052672367.1 | WP_073631249.1 |
|---|---|---|---|---|---|
| WP_002738122.1 | 290 | 298 | 340 | 347 | 335 |
| WP_006635899.1 | 254 | 254 | 320 | 330 | 306 |
| WP_015178512.1 | 254 | 248 | 321 | 326 | 310 |
| WP_015204462.1 | 325 | 329 | 377 | 380 | 374 |
| WP_028091425.1 | 155 | 153 | 271 | 285 | 268 |
| OBQ01436.1 | 155 | 152 | 273 | 287 | 265 |
| OBQ25779.1 | 155 | 153 | 275 | 288 | 268 |
| WP_039200563.1 | 151 | 145 | 275 | 287 | 267 |
| WP_012407347.1 | 75 | 58 | 263 | 273 | 247 |
| WP_027843955.1 | 203 | 214 | 276 | 288 | 270 |
| WP_073641301.1 | ID | 71 | 253 | 273 | 236 |
| WP_096647440.1 | 0.87 | ID | 256 | 272 | 242 |
| WP_099099431.1 | 0.54 | 0.534 | ID | 185 | 114 |
| WP_052672367.1 | 0.502 | 0.504 | 0.661 | ID | 174 |
| WP_073631249.1 | 0.57 | 0.56 | 0.791 | 0.681 | ID |
| WP_013220336.1 | 0.5 | 0.493 | 0.608 | 0.55 | 0.612 |
| UfLOX2 | 0.354 | 0.35 | 0.343 | 0.332 | 0.331 |
| CoLOX-3 | 0.148 | 0.15 | 0.136 | 0.143 | 0.144 |
| AFQ59981.1 | 0.131 | 0.132 | 0.131 | 0.136 | 0.127 |
| AGN54275.1 | 0.13 | 0.131 | 0.126 | 0.126 | 0.129 |

| | WP_013220336.1 | UfLOX2 | CoLOX-3 | AFQ59981.1 | AGN54275.1 |
|---|---|---|---|---|---|
| WP_002738122.1 | 354 | 353 | 812 | 803 | 807 |
| WP_006635899.1 | 327 | 353 | 804 | 788 | 801 |
| WP_015178512.1 | 331 | 353 | 804 | 786 | 797 |
| WP_015204462.1 | 400 | 386 | 864 | 852 | 853 |
| WP_028091425.1 | 272 | 373 | 783 | 769 | 783 |
| OBQ01436.1 | 273 | 374 | 783 | 772 | 784 |
| OBQ25779.1 | 278 | 376 | 782 | 771 | 784 |
| WP_039200563.1 | 277 | 373 | 783 | 773 | 787 |
| WP_012407347.1 | 276 | 380 | 796 | 781 | 785 |
| WP_027843955.1 | 292 | 381 | 795 | 785 | 788 |
| WP_073641301.1 | 275 | 379 | 791 | 784 | 789 |
| WP_096647440.1 | 279 | 381 | 789 | 783 | 788 |
| WP_099099431.1 | 214 | 386 | 805 | 785 | 793 |

TABLE 8-continued

| The sequence identity of the LOXs. | | | | | |
|---|---|---|---|---|---|
| WP_052672367.1 | 246 | 392 | 797 | 780 | 792 |
| WP_073631249.1 | 212 | 393 | 797 | 789 | 790 |
| WP_013220336.1 | ID | 398 | 804 | 795 | 798 |
| UfLOX2 | 0.323 | ID | 823 | 796 | 789 |
| CoLOX-3 | 0.133 | 0.129 | ID | 777 | 790 |
| AFQ59981.1 | 0.12 | 0.131 | 0.211 | ID | 467 |
| AGN54275.1 | 0.121 | 0.142 | 0.202 | 0.493 | ID |

Example 8: Expression and Functional Characterization of the Mined Bacterial LOXs The coding sequences of the bifunctional LOXs were optimized by following the genetic codon frequency of *E. coli*, synthesized and then subcloned into the pETDuet-1 plasmid for subsequent expression in *E. coli*.

Functional expression of the mined LOXs was performed as described above in the Methods section. The different LOX proteins expressed by *E. coli* were released by sonication in 25 mM Tris-HCl buffer (pH7.5) to deliver LOX protein solution, respectively. Each LOX protein solution was transferred into a 20 mL SPME vial, 30 μL of GLA and 10 μL of internal standard were added into the vial. After 10 min incubation, SPME-GC-MS was used for analysis of decadienals, decatrienals and hexanal, and LC-UV was used for analysis of decadienals, decatrienals and the GLA-HPO (intermediate between gamma-linolenic acid and decadienals). SPME-GC-MS was performed as described in the Methods section above. GC-MS analysis revealed 2E,4Z-decadienal (retention time 13.0 min), 2E,4E-decadienal (retention time 13.25) and hexanal in the reactions for each LOX but with different levels. LC-UV revealed 2E,4Z-decadienal (retention time 6.61 min at 280 nm), 2E,4E-decadienal (retention time 6.62 min at 280 nm) and GLA-HPO (retention time 6.90 min at 235 nm).

The selectivity, bifunctionality and productivity of LOXs for the decadienal end product from the GLA substrate were calculated and shown in Table 9 below (UfLOX2 and CoLOX-3 were involved for comparison). The selectivity can be deduced by calculating the peak area ratio of decadienal ($C_{10}$) to hexanal ($C_6$). The productivity can be deduced from the peak area of decadienal. The bifunctionality can be deduced by calculating the peak area ratio of decadienal ($C_{10}$) to GLA-HPO (intermediate). In this comparison, UfLOX2 remains the best bifunctional LOX, followed by cyanobacterial bifunctional LOX WP_002738122.1 (from *Microcystis aeruginosa*) and WP_015204462.1 (from *Crinalium epipsammum*). There are still some cyanobacterial LOXs with similar activity compared to CoLOX-3, e.g. WP_039200563.1, WP_073641301.1.

TABLE 9

The analytical data related to selectivity, bifunctionality and productivity of LOXs.

| Protein ID | Peak area of Hexanal in GC-MS | Peak area of Decadienal in GC-MS | Peak area of Decadienal in LC-UV | Peak area of GLA-HPO in LC-UV | Selectivity | Bifunctionality |
|---|---|---|---|---|---|---|
| WP_002738122.1 | 170000000 ± 20000000 | 1200000000 ± 380000000N | 91.5 ± 33.5 | 85.5 ± 64.5 | 7.058824 | 1.070175 |
| WP_006635899.1 | 160000000 ± 44000000 | 34000000 ± 30000000 | 29 ± 13 | 405.5 ± 77.5N | 0.2125 | 0.071517 |
| WP_015178512.1 | 200000000 ± 14000000 | 62000000 ± 34000000 | 15 ± 15 | 87 ± 31 | 0.31 | 0.172414 |
| WP_015204462.1 | 120000000 ± 72000000 | 800000000 ± 670000000 | 48.67 ± 29.41 | 277.4 ± 49.45 | 6.666667 | 0.175439 |
| WP_028091425.1 | 190000000 ± 17000000 | 49000000 ± 50000000 | 35.25 ± 19.15 | 319.5 ± 181.7 | 0.257895 | 0.110329 |
| OBQ01436.1 | 240000000 ± 19000000 | 12000000 ± 6700000N | 21.5 ± 1.5N | 475 ± 97N | 0.05 | 0.045263 |
| OBQ25779.1 | 240000000 ± 31000000 | 62000000 ± 53000000 | 6.35 ± 1.25 | 5.5 ± 0.5 | 0.258333 | 1.154545 |
| WP_039200563.1 | 210000000 ± 30000000 | 88000000 ± 75000000 | 17.5 ± 2.5N | 502.5 ± 2.5M | 0.419048 | 0.034826 |
| WP_012407347.1 | 210000000 ± 15000000 | 16000000 ± 8200000 | 17.5 ± 2.5N | 550 ± 150 | 0.07619 | 0.031818 |
| WP_027843955.1 | 230000000 ± 22000000 | 18000000 ± 10000000 | 24.5 ± 0.5N | 870 ± 30N | 0.078261 | 0.028161 |
| WP_073641301.1 | 220000000 ± 14000000 | 78000000 ± 43000000 | 35.5 ± 0.5N | 733 ± 107 | 0.354545 | 0.048431 |
| WP_096647440.1 | 190000000 ± 68000000 | 11000000 ± 5500000N | 20.45 ± 10.55 | 654 ± 1M | 0.057895 | 0.031269 |
| WP 099099431.1 | 210000000 ± 30000000 | 15000000 ± 5500000N | 7.55 ± 1.15 | 25.5 ± 4.5N | 0.071429 | 0.296078 |
| WP_052672367.1 | 180000000 ± 4500000N | 13000000 ± 7200000N | 7.2 ± 0TN | 20 ± 0N | 0.072222 | 0.36 |
| WP_073631249.1 | 200000000 ± 27000000 | 18000000 ± 14000000 | 8.7 ± 1.3 | 22.5 ± 2.5N | 0.09 | 0.386667 |
| WP_013220336.1 | 200000000 ± 43000000 | 23000000 ± 18000000 | 5.8 ± 0.8 | 15 ± 5N | 0.115 | 0.386667 |
| UfLOX2 | 150000000 ± 49000000 | 1500000000 ± 670000000N | 248.6 ± 35.27 | NT17 ± 9.27 | 10 | 14.62353 |
| CoLOX-3 | 90000000 ± 3900000 | 380000000 ± 170000000 | 43 ± 0N | 404.7 ± 0TMN | 4.222222 | 0.106252 |

Part D

Further Characterization of LOXs of the Invention

Example 9: Characterization of the Key Amino Acids in High Performance LOXs

Figure 11:
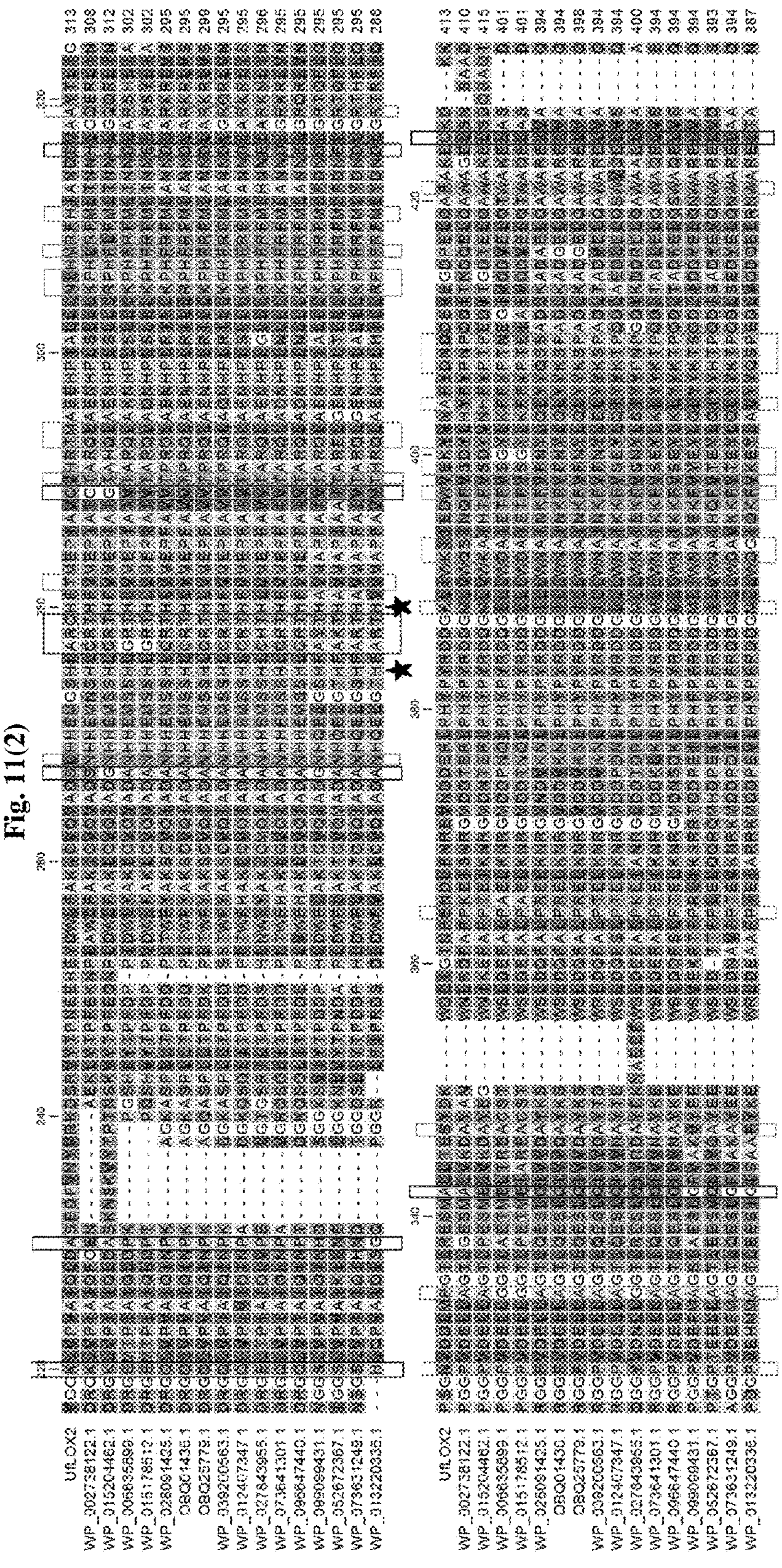
FIG. 11. Sequence alignment of UfLOX2 and bacterial LOX to mine key amino acid residues.
Figure 11:
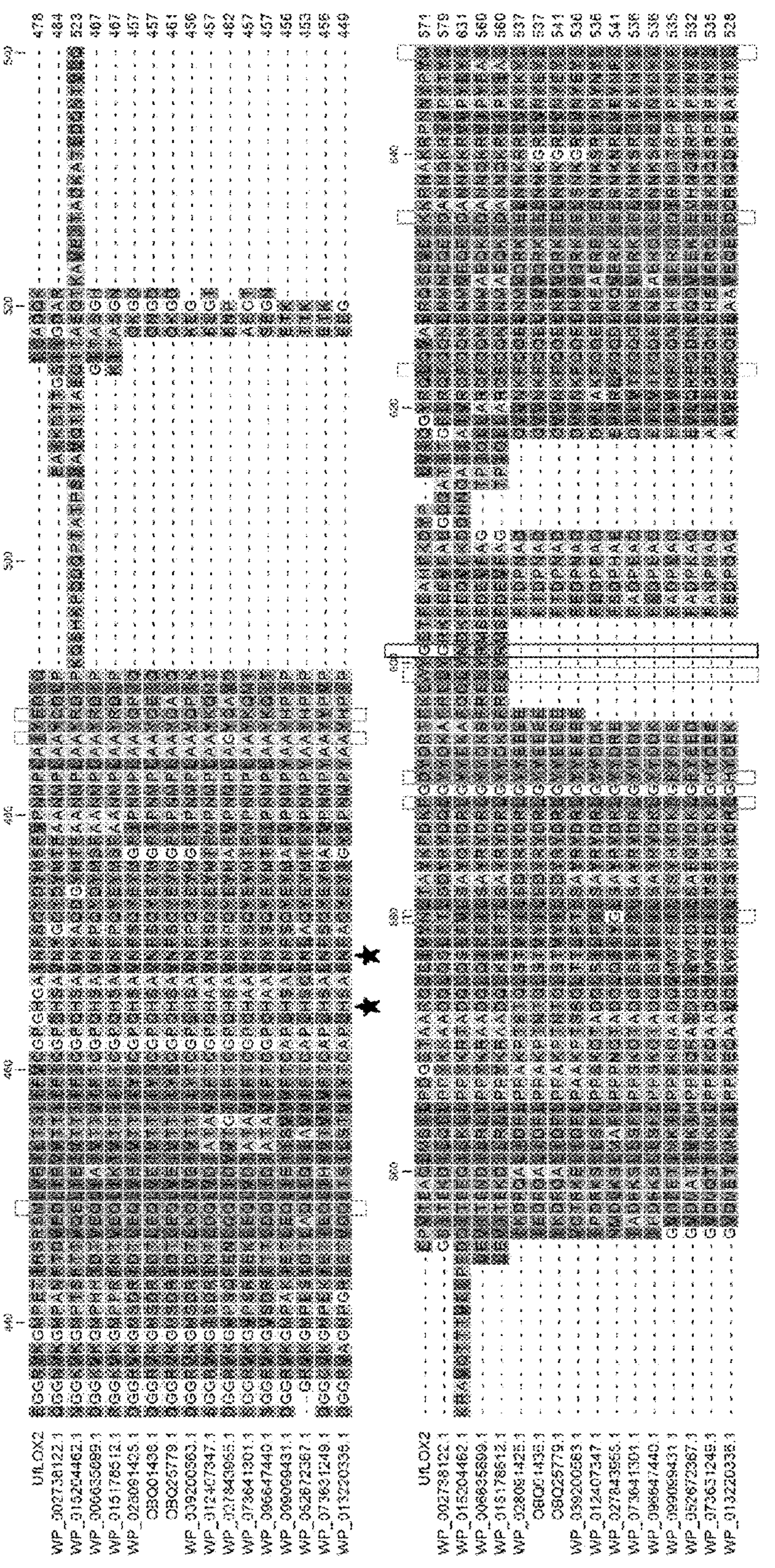
Figure 11:
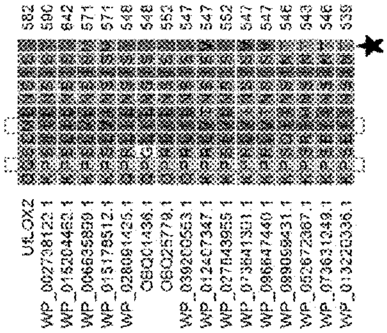

Experiment 1:

High performance LOXs, UfLOX2 and WP_002738122.1 and WP_015204462.1 were compared with the other less active LOXs in an alignment view (see FIG. 11). For mining potential key amino acid residues for high activity LOX, a number of potential positions were selected and marked by stars (indicating potential key positions) and dots (indicating other potential positions).

The importance of some of the identified conserved residues by mutagenesis studies was investigated. The results are summarized in Table 10.

TABLE 10

Modified amino acids of UfLOX2 for functional study.

| Gene ID | AA Position in UfLOX2[2)] | Original AA | Designed AA | Comment |
|---|---|---|---|---|
| UfLOX2-C7Y | 7 | C | Y | shared by UfLOX2 and WP_002738122.1 |
| UfLOX2-D134P/R136N[1)] | 134, 135, 136 | DAR | PAN | shared by UfLOX2 and WP_002738122.1 |
| UfLOX2-D142K/M143F | 142-143 | DM | KF | only in UfLOX2 |
| UfLOX2-N150E | 150 | N | E | shared by UfLOX2 and WP_002738122.1 |
| UfLOX2-C161A | 161 | C | A | only in UfLOX2 |
| UfLOX2-C174A | 174 | C | A | only in UfLOX2 |
| UfLOX2-K209Q | 209 | K | Q | shared by UfLOX2 and WP_002738122.1 |
| UfLOX2-A219P | 219 | A | P | shared by UfLOX2 and WP_015204462.1 |
| UfLOX2-S256A | 256 | S | A | shared by UfLOX2 and WP_002738122.1 |
| UfLOX2-C268T | 268 | C | T | only in UfLOX2 |
| UfLOX2-C278V | 278 | C | V | only in UfLOX2 |
| UfLOX2-S305D | 305 | S | D | UfLOX2, WP_015204462.1 and WP_002738122.1 are different from the others |
| UfLOX2-A331Q | 331 | A | Q | shared by UfLOX2 and WP_002738122.1 |
| UfLOX2-C409L | 409 | C | L | only in UfLOX2 |
| UfLOX2-G526R | 526 | G | R | shared by UfLOX2 and WP_002738122.1 |

[1)] Double mutation in positions 134 and 136

[2)] Numbering relates to SEQ ID NO: 18

Figure 12:
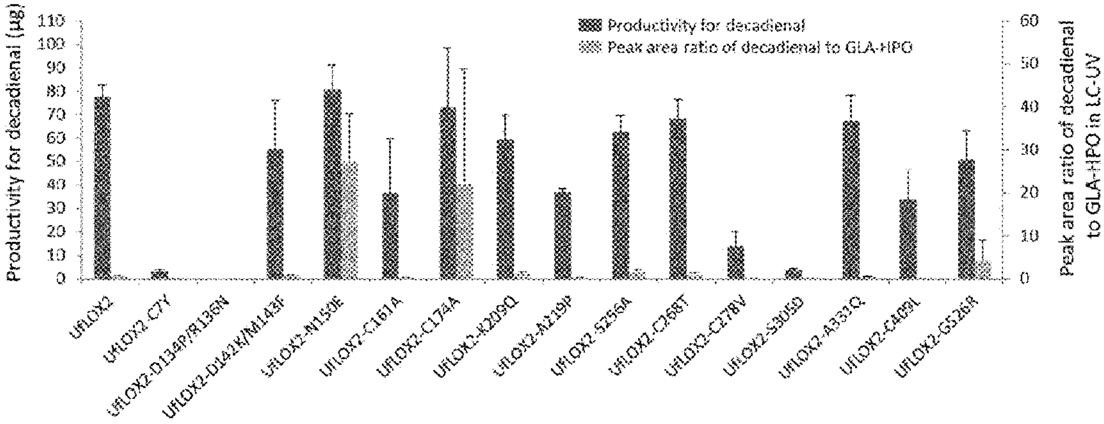
FIG. 12. The results of mutagenesis studies of UfLOX2.

In a first series of mutagenesis studies, some UfLOX2 mutants showed reduced activity, see in FIG. 12.

Based on these date the following may be concluded:

1) D142/M143, N150, C174, K209, C268 and A331 are not key to the activity;
2) C7, D134/R136, C161, A219, S256, C278, S305, C409 and G526 are key to the activity, as the corresponding mutants shown reduced activity at different levels.

Experiment 2:

The residues identified in Experiment 1 were introduced into several bacterial LOXs with several other residues that are conserved in bacterial LOXs to improve productivity. The designed sequences are as shown in Table 11.

TABLE 11

Modified amino acids of LOX mutants.

| SEQ ID NOs | Gene ID | Amino acid mutations |
|---|---|---|
| 253-254 | WP_002738122.1mut | A167C, G273C, H300S, L404C |
| 255-256 | WP_002738122.1mut2 | N156E, A167C, S180C, L181M, G273C, L404C |

TABLE 11-continued

| Modified amino acids of LOX mutants. | | |
|---|---|---|
| SEQ ID NOs | Gene ID | Amino acid mutations |
| 257-258 | WP_015204462.1mut | Y5C, P129A, T162C, G277C, H304S, L408C |
| 259-260 | WP_015204462.1mut2 | Y5C, T162C, G255S, G277C, H304S, L408C, N584G |
| 261-262 | WP_015204462.1mut3 | Y5C, P129A, R151E, T162C, K208Q, A218P, G255A, G277C, H304S, L408C |
| 263-264 | WP_006635899.1mut | L8C, S132A, A161C, V267C, D294S, L398C |
| 265-266 | WP_015178512.1mut | S8C, P132A, A161C, V267C, E294S, L398C |
| 283-284 | WP_099099431.1mut | Y4C, P127D, D128A, N129R, L159C, V260C, D287S, L391C |

The coding sequences of the mutants of bacterial LOXs were optimized by following the genetic codon frequency of *E. coli*, synthesized and then subcloned into the pETDuet-1 plasmid for subsequent expression in *E. coli.*

Figure 18:
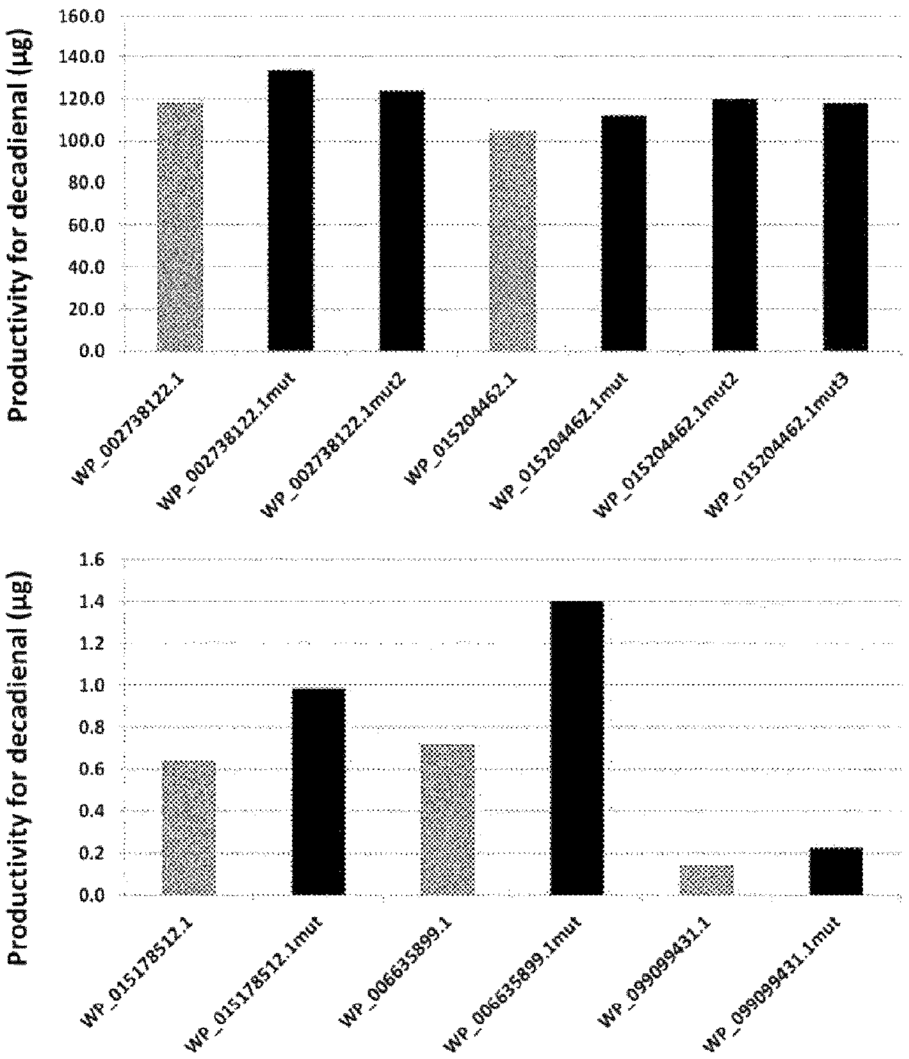
FIG. 18. The average productivity of bacterial LOX mutants (black) compared to their natural sequences (grey), respectively.

Functional expression of the mutants of bacterial LOXs was performed as described above in the Methods section. The different LOX proteins expressed by *E. coli* were released by sonication in 25 mM Tris-HCl buffer (pH7.5) to deliver LOX protein solution, respectively. Each LOX protein solution was transferred into a 20 mL SPME vial, 30 μL of GLA and 104 of internal standard were added into the vial. After 10 min incubation, LC-UV was used for analysis of decadienals. The productivity of LOX mutants for the decadienal end product were calculated and shown in FIG. 18 (their natural counterparts were involved for comparison). WP_002738122.1mut, WP_002738122.1mut2, WP_015204462.1mut, WP_015204462.1mut2, WP_015204462.1mut3, WP_015178512.1mut, WP_006635899.1mut and WP_099099431.1mut shown increased productivity compared to their natural counterparts.

Example 10: Characterization of the Cofactors for LOXs

Figure 13:
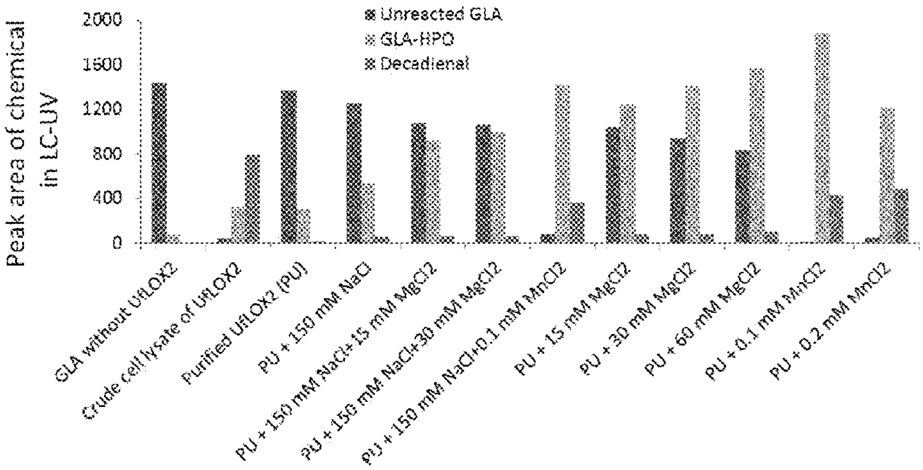
FIG. 13. Influence of different cofactors on the activity of UfLOX2.
Figure 14:
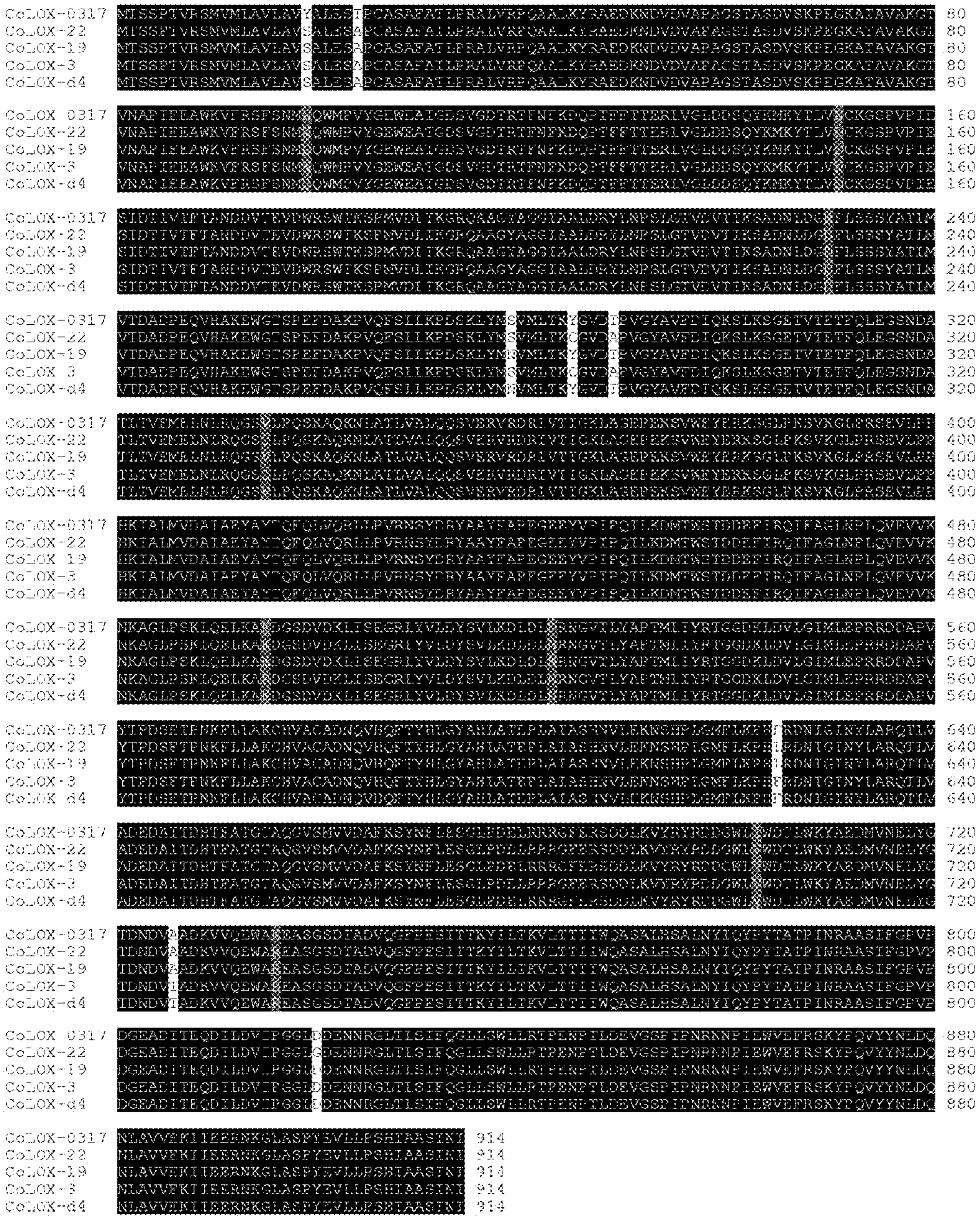
FIG. 14. Alignment of different CoLOX amino acid sequences to generate consensus sequence of SEQ ID NO:51.
Figure 15:
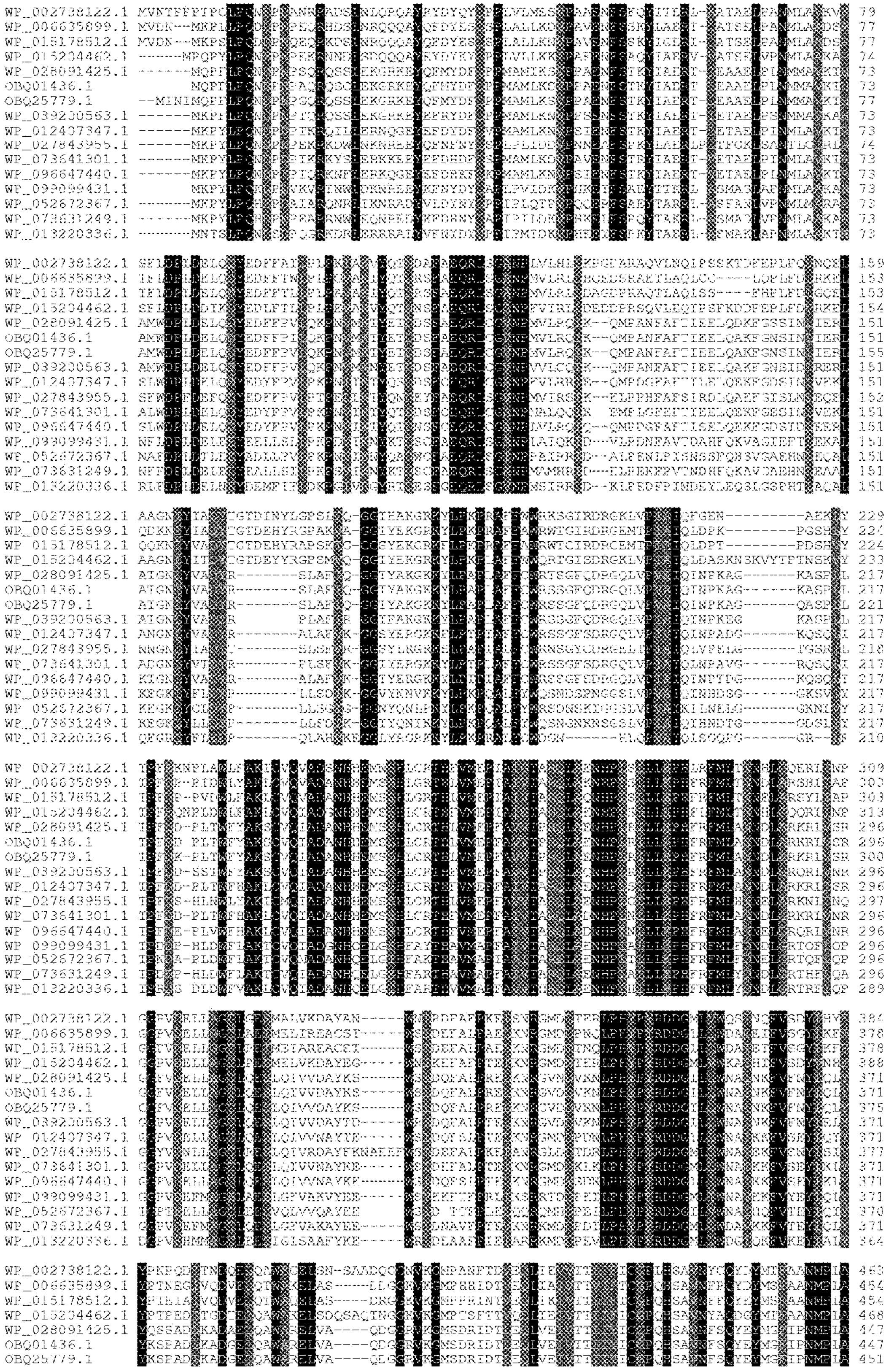
FIG. 15. Alignment of different bacterial LOX amino acid sequences to generate consensus sequence of SEQ ID NO:52.
Figure 15:
Figure 16:
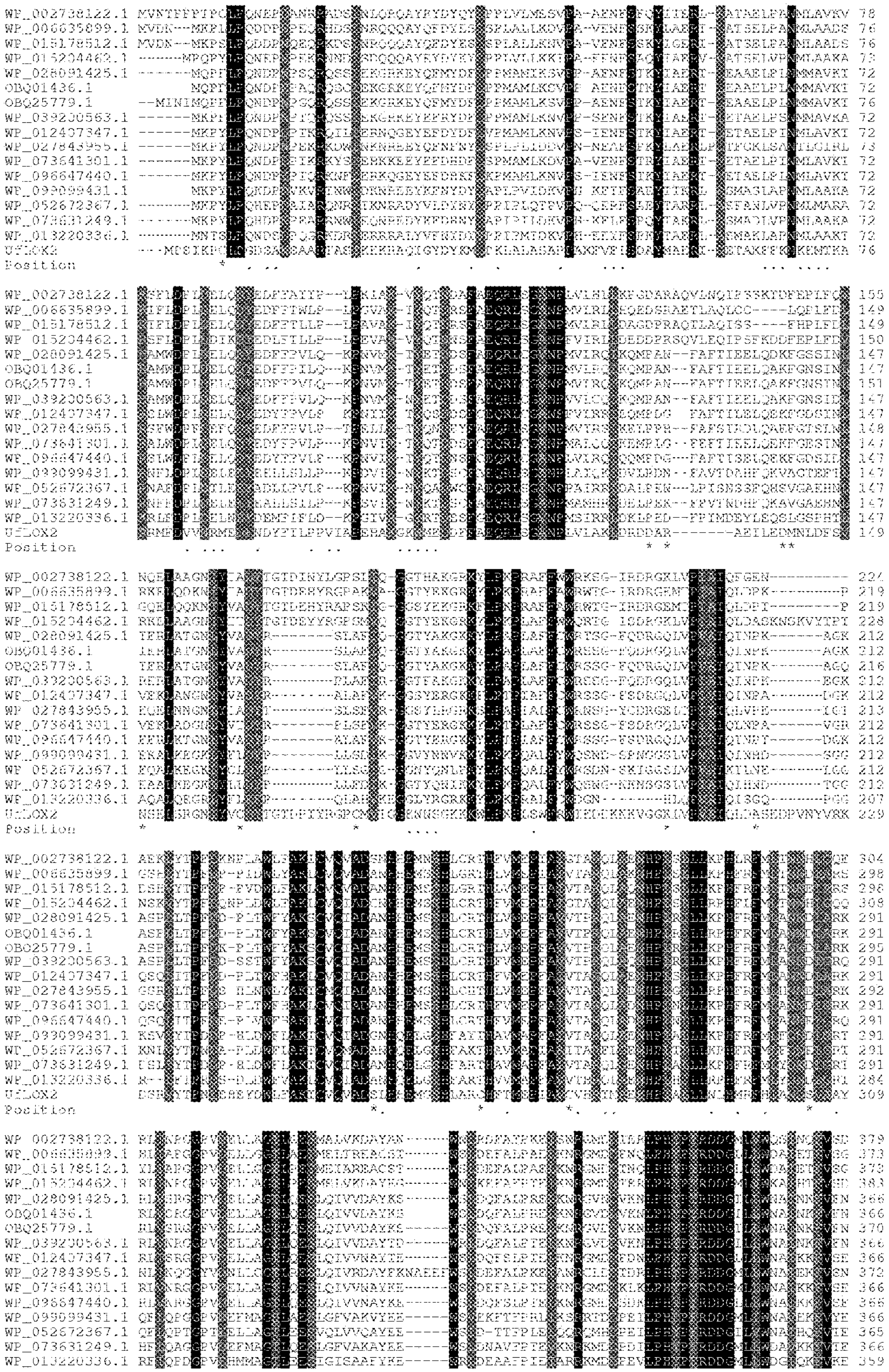
FIG. 16. Alignment of UfLOX2 and different bacterial LOX amino acid sequences to generate consensus sequence of SEQ ID NO:53.
Figure 16:
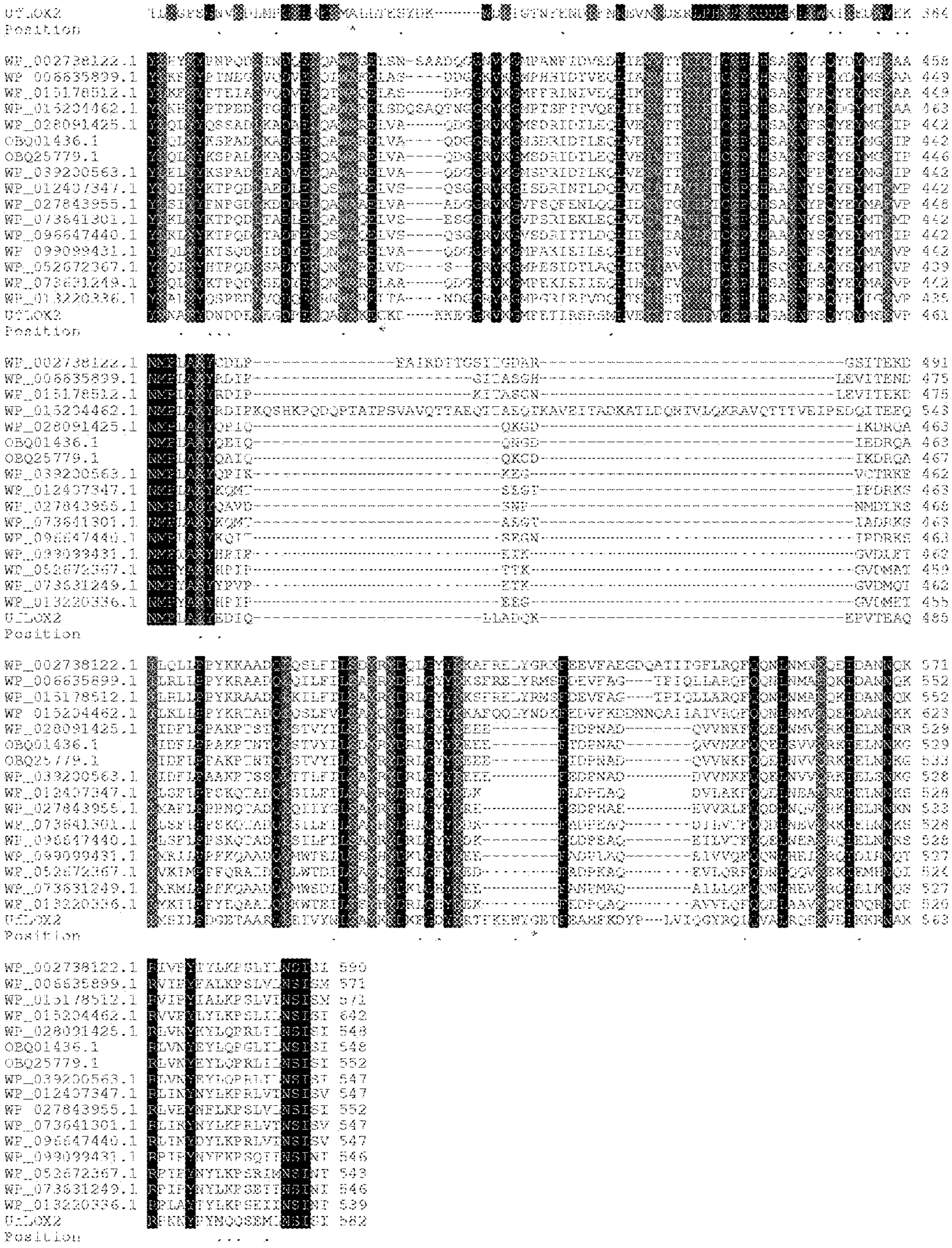
Figure 17:
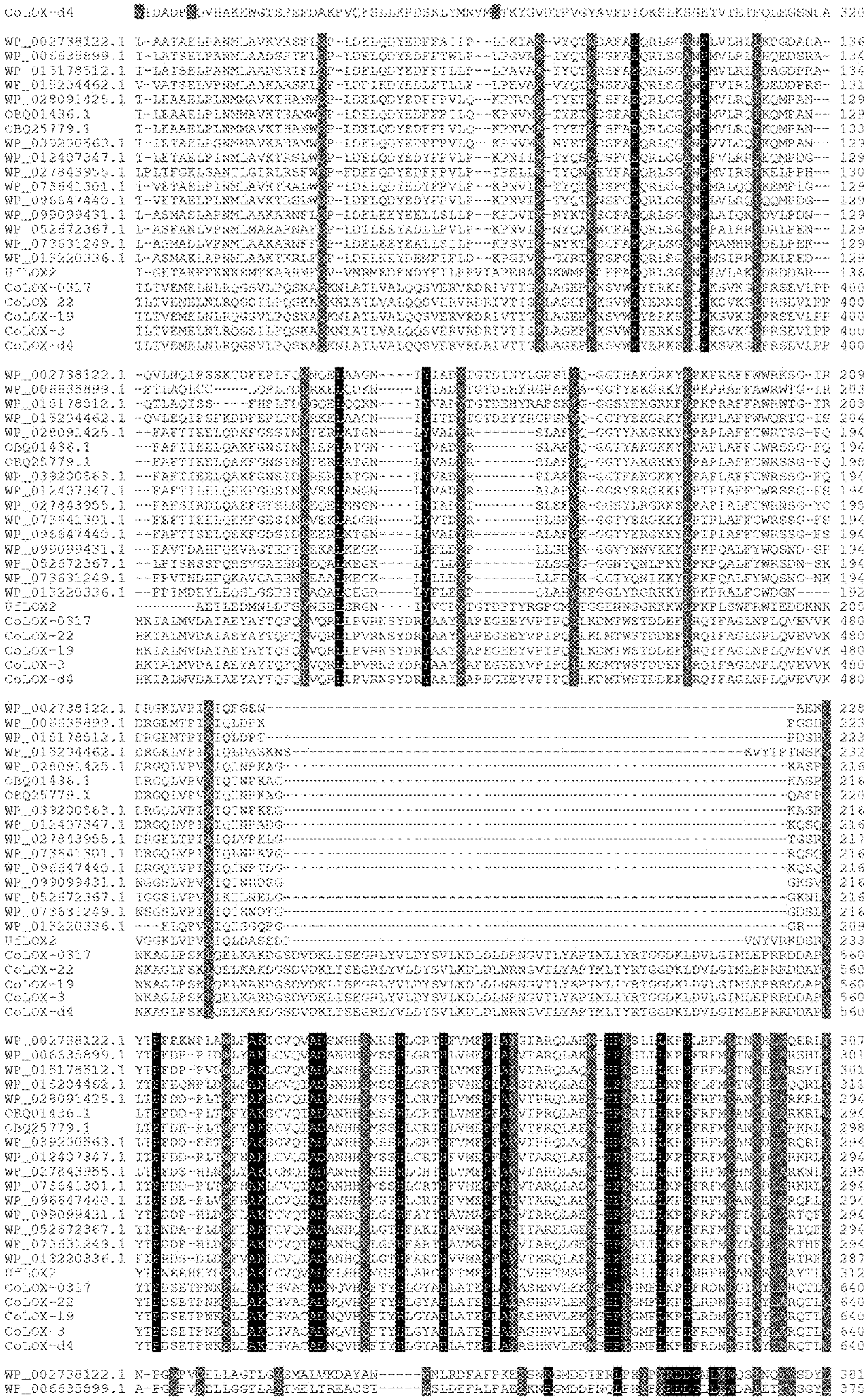
FIG. 17. Alignment of different CoLOXs, UfLOX2 and different bacterial LOX amino acid sequences to generate consensus sequence of SEQ ID NO:54.
Figure 17:

Previous studies indicated that five essential conserved amino acid residues in the active site are involved in the binding of cofactors as described by Toralf Senger, et al., J. Biol. Chem. 2005, 280:7588-7596 (residues cited therein as His-585, His-590, His-774, Asn-778 and Ile-899). Both iron and manganese were reported to be the cofactors as described by Alexandra Andreou, et al., J. Biol. Chem. 2010. The algal LOXs and the bacterial LOXs also have these five conservative residues as shown in said alignment in FIG. 11, indicating that addition of iron and manganese might improve the activity of LOXs. We therefore tested the importance of iron and manganese on the activity of UfLOX2. The observed results show clearly the importance of adding manganese (to a lesser extent magnesium) to the reaction for enhancing the enzyme activity. Manganese is therefore important for enabling/improving the LOX activity. The results are summarized in FIG. 13. We have also tested iron in the assay, however, the effect is not as significant as using manganese (data not shown).

Example 11: Downstream Products Profiling

In the case of making decadienal by using UfLOX2 and gamma-linolenic acid, the molar yield for total decadienal (including 2E,4Z-decadienal and 2E,4E-decadienal) is approx. 30-40% based on quantification by LC-UV/MS with external calibration as described above in the Methods section. However, the overall percentage for decadienal, based total volatiles is above 90%.

To obtain information of other downstream side products, UfLOX2 was produced in *E. coli.* Cell lysates (20 ml) that contain UfLOX2 were fed with GLA at room temperature. 200 μl sample aliquots were picked up and mixed with 800 μl acetonitrile for further LC-UV/MS analysis as described above in the Methods section. Nine side product (see Table 12) were proposed based on the observed mass spectra as well as comparison with literature.

TABLE 12

| Side products | |
|---|---|
| Chemical name | Remark |
| 8,9-dihydroperoxyoctadeca-6,10,12-trienoic acid | Over oxidation of GLA peroxide |
| 8,9-dihydroxyoctadeca-6,10,12-trienoic acid | Isomerization of GLA peroxide |
| (6,9,12)-9-(non-3-en-1-ylidene)-10-((nona-1,3-dien-1-yl)octadeca-6,12-dienedioic acid | Combination of peroxide and GLA |
| 2-(octa-1,3-dien-1-yl)oxirane | Oxidation of decadienal |
| 9-hydroxyoctadeca-6,10,12-trienoic acid | Reduction of GLA peroxide |
| 8-oxooct-6-enoic acid | Degradation product of GLA peroxide |
| non-3-enedioic acid | Degradation product of GLA peroxide |
| 8-hydroxyoct-6-enoic acid | Degradation product of GLA peroxide |
| 7-hydroxynon-8-enoic acid | Degradation product of GLA peroxide |

All the publications mentioned in this application are incorporated by reference to disclose and describe the methods and/or materials in connection with which the publications are cited.

Listing of Sequences

TABLE 13

Sequences described and used herein

| SEQ ID NO | Name | Source | Type |
|---|---|---|---|
| | | Algeal LOX | |
| 1 | Coding sequence for CoLOX-3 | *Cladophora oligoclada* | NA |
| 2 | Codon-optimized coding sequence of CoLOX-3 | artificial | NA |
| 3 | Amino acid sequence for CoLOX-3 | *Cladophora oligoclada* | AA |
| 4 | Coding sequence for CoLOX-0317 | *Cladophora oligoclada* | NA |
| 5 | Codon-optimized coding sequence of CoLOX-0317 | artificial | NA |
| 6 | Amino acid sequence for CoLOX-0317 | *Cladophora oligoclada* | AA |
| 7 | Coding sequence for CoLOX-19 | *Cladophora oligoclada* | NA |
| 8 | Codon-optimized coding sequence of CoLOX-19 | artificial | NA |
| 9 | Amino acid sequence for CoLOX-19 | *Cladophora oligoclada* | AA |
| 10 | Coding sequence for CoLOX-22 | *Cladophora oligoclada* | NA |
| 11 | Codon-optimized coding sequence of CoLOX-22 | artificial | NA |
| 12 | Amino acid sequence for CoLOX-22 | *Cladophora oligoclada* | AA |
| 13 | Coding sequence for CoLOX-d4 | *Cladophora oligoclada* | NA |
| 14 | Codon-optimized coding sequence of CoLOX-d4 | artificial | NA |
| 15 | Amino acid sequence for CoLOX-d4 | *Cladophora oligoclada* | AA |
| 16 | Coding sequence for UfLOX2 | *Ulva fasciata* | NA |
| 17 | Codon-optimized coding sequence of UfLOX2 | artificial | NA |
| 18 | Amino acid sequence for UfLOX2 | *Ulva fasciata* | AA |
| | | Bacterial LOX | |
| 19 | Codon-optimized coding sequence for WP_002738122.1 | artificial | NA |
| 20 | Amino acid sequence for WP_002738122.1 | *Microcystis aeruginosa* | AA |
| 21 | Codon-optimized coding sequence for WP_006635899.1 | artificial | NA |
| 22 | Amino acid sequence for WP_006635899.1 | *Microcoleus vaginatus* | AA |
| 23 | Codon-optimized coding sequence for WP_015178512.1 | artificial | NA |
| 24 | Amino acid sequence for WP_015178512.1 | *Oscillatoria nigro-viridis* | AA |
| 25 | Codon-optimized coding sequence for WP_015204462.1 | artificial | NA |
| 26 | Amino acid sequence for WP_015204462.1 | *Crinalium epipsammum* | AA |
| 27 | Codon-optimized coding sequence for WP_028091425.1 | artificial | NA |
| 28 | Amino acid sequence for WP_028091425.1 | *Dolichospermum circinale* | AA |
| 29 | Codon-optimized coding sequence for OBQ01436.1 | artificial | NA |
| 30 | Amino acid sequence for OBQ01436.1 | *Anabaena* sp. AL09 | AA |
| 31 | Codon-optimized coding sequence for OBQ25779.1 | artificial | NA |
| 32 | Amino acid sequence for OBQ25779.1 | *Aphanizomenon flos-aquae* LD13 | AA |
| 33 | Codon-optimized coding sequence for WP_039200563.1 | artificial | NA |
| 34 | Amino acid sequence for WP_039200563.1 | *Aphanizomenon flos-aquae* | AA |
| 35 | Codon-optimized coding sequence for WP_012407347.1 | artificial | NA |
| 36 | Amino acid sequence for WP_012407347.1 | *Nostoc punctiforme* | AA |
| 37 | Codon-optimized coding sequence for WP_027843955.1 | artificial | NA |
| 38 | Amino acid sequence for WP_027843955.1 | *Mastigocoleus testarum* | AA |
| 39 | Codon-optimized coding sequence for WP_073641301.1 | artificial | NA |
| 40 | Amino acid sequence for WP_073641301.1 | *Nostoc calcicola* | AA |
| 41 | Codon-optimized coding sequence for WP_096647440.1 | artificial | NA |

TABLE 13-continued

| Sequences described and used herein | | | |
|---|---|---|---|
| SEQ ID NO | Name | Source | Type |
| 42 | Amino acid sequence for WP_096647440.1 | *Calothrix brevissima* | AA |
| 43 | Codon-optimized coding sequence for WP_099099431.1 | artificial | NA |
| 44 | Amino acid sequence for WP_099099431.1 | *Nostoc* sp. '*Peltigera malacea cyanobiont*' DB3992 | AA |
| 45 | Codon-optimized coding sequence for WP_052672367.1 | artificial | NA |
| 46 | Amino acid sequence for WP_052672367.1 | *Aliterella atlantica* | AA |
| 47 | Codon-optimized coding sequence for WP_073631249.1 | artificial | NA |
| 48 | Amino acid sequence for WP_073631249.1 | *Scytonema* sp. HK-05 | AA |
| 49 | Codon-optimized coding sequence for WP_013220336.1 | artificial | NA |
| 50 | Amino acid sequence for WP_013220336.1 | *Nitrosococcus watsonii* | AA |
| Consensus Sequences | | | |
| 51 | Consensus sequence of CoLox | artificial | AA |
| 52 | Consensus sequence for the protein sequences of bacterial LOX | artificial | AA |
| 53 | Consensus sequence for bacterial LOX and UfLOX2 protein sequences | artificial | AA |
| 54 | Consensus sequence for bacterial LOX, CoLOXs and UfLOX2 protein sequences | artificial | AA |
| Miscellaneous | | | |
| 55 | CoLOX forward primer | artificial | NA |
| 56 | CoLOX reverse primer | artificial | NA |
| 57 | UfLOX2 forward primer | artificial | NA |
| 58 | UfLOX2 reverse primer | artificial | NA |
| Bacterial LOX cont. | | | |
| 59 | Coding sequence for WP_002738122.1 | *Microcystis aeruginosa* | NA |
| 60 | Coding sequence for WP 006635899.1 | *Microcoleus vaginatus* | NA |
| 61 | Coding sequence for WP_015178512.1 | *Oscillatoria nigro-viridis* | NA |
| 62 | Coding sequence for WP_015204462.1 | *Crinalium epipsammum* | NA |
| 63 | Coding sequence for WP_028091425.1 | *Dolichospermum circinale* | NA |
| 64 | Coding sequence for OBQ01436.1 | *Anabaena* sp. AL09 | NA |
| 65 | Coding sequence for OBQ25779.1 | *Aphanizomenon flos-aquae* LD13 | NA |
| 66 | Coding sequence for WP_039200563.1 | *Aphanizomenon flos-aquae* | NA |
| 67 | Coding sequence for WP_012407347.1 | *Nostoc punctiforme* | NA |
| 68 | Coding sequence for WP_027843955.1 | *Mastigocoleus testarum* | NA |
| 69 | Coding sequence for WP_073641301.1 | *Nostoc calcicola* | NA |
| 70 | Coding sequence for WP_096647440.1 | *Calothrix brevissima* | NA |
| 71 | Coding sequence for WP_099099431.1 | *Nostoc* sp. '*Peltigera malacea cyanobiont*' DB3992 | NA |
| 72 | Coding sequence for WP_052672367.1 | *Aliterella atlantica* | NA |
| 73 | Coding sequence for WP_073631249.1 | *Scytonema* sp. HK-05 | NA |
| 74 | Coding sequence for WP_013220336.1 | *Nitrosococcus watsonii* | NA |
| Mined LOX | | | |
| 75 | Coding sequence for WP_108935963.1 | *Microcystis* sp. 0824 | NA |
| 76 | Amino acid sequence for WP_108935963.1 | *Microcystis* sp. 0824 | AA |
| 77 | Coding sequence for WP_110985169.1 | *Acaryochloris* sp. RCC1774 | NA |
| 78 | Amino acid sequence for WP_110985169.1 | *Acaryochloris* sp. RCC1774 | AA |
| 79 | Coding sequence for WP_053540410.1 | *Anabaena* sp. WA102 | NA |
| 80 | Amino acid sequence for WP_053540410.1 | *Anabaena* sp. WA102 | AA |
| 81 | Coding sequence for WP_035367771.1 | *Dolichospermum circinale* | NA |
| 82 | Amino acid sequence for WP_035367771.1 | *Dolichospermum circinale* | AA |
| 83 | Coding sequence for OBQ35765.1 | *Anabaena* sp. CRKS33 | NA |
| 84 | Amino acid sequence for OBQ35765.1 | *Anabaena* sp. CRKS33 | AA |
| 85 | Coding sequence for OBQ09764.1 | *Anabaena* sp. LE011-02 | NA |
| 86 | Amino acid sequence for OBQ09764.1 | *Anabaena* sp. LE011-02 | AA |
| 87 | Coding sequence for OBQ23315.1 | *Anabaena* sp. AL93 | NA |

TABLE 13-continued

| SEQ ID NO | Name | Source | Type |
|---|---|---|---|
| | Sequences described and used herein | | |
| 88 | Amino acid sequence for OBQ23315.1 | *Anabaena* sp. AL93 | AA |
| 89 | Coding sequence for OBQ30848.1 | *Aphanizomenon flos-aquae* MDT14a | NA |
| 90 | Amino acid sequence for OBQ30848.1 | *Aphanizomenon flos-aquae* MDT14a | AA |
| 91 | Coding sequence for OBQ23778.1 | *Anabaena* sp. WA113 | NA |
| 92 | Amino acid sequence for OBQ23778.1 | *Anabaena* sp. WA113 | AA |
| 93 | Coding sequence for WP_015083575.1 | *Anabaena* sp. 90 | NA |
| 94 | Amino acid sequence for WP_015083575.1 | *Anabaena* sp. 90 | AA |
| 95 | Coding sequence for WP_027404620.1 | *Aphanizomenon flos-aquae* | NA |
| 96 | Amino acid sequence for WP_027404620.1 | *Aphanizomenon flos-aquae* | AA |
| 97 | Coding sequence for WP_114084873.1 | *Nostoc* sp. ATCC 53789 | NA |
| 98 | Amino acid sequence for WP_114084873.1 | *Nostoc* sp. ATCC 53789 | AA |
| 99 | Coding sequence for WP_096538768.1 | *Nostoc linckia* | NA |
| 100 | Amino acid sequence for WP_096538768.1 | *Nostoc linckia* | AA |
| 101 | Coding sequence for RCJ25669.1 | *Nostoc* sp. ATCC 43529 | NA |
| 102 | Amino acid sequence for RCJ25669.1 | *Nostoc* sp. ATCC 43529 | AA |
| 103 | Coding sequence for WP_017318478.1 | *Mastigocladopsis repens* | NA |
| 104 | Amino acid sequence for WP_017318478.1 | *Mastigocladopsis repens* | AA |
| 105 | Coding sequence for KJH71567.1 | *Aliterella atlantica* CENA595 | NA |
| 106 | Amino acid sequence for KJH71567.1 | *Aliterella atlantica* CENA595 | AA |
| 107 | Coding sequence for WP_017327314.1 | *Synechococcus* sp. PCC 7336 | NA |
| 108 | Amino acid sequence for WP_017327314.1 | *Synechococcus* sp. PCC 7336 | AA |
| 109 | Coding sequence for WP_100898502.1 | *Nostoc flagelliforme* | NA |
| 110 | Amino acid sequence for WP_100898502.1 | *Nostoc flagelliforme* | AA |
| 111 | Coding sequence for RCJ35150.1 | *Nostoc punctiforme* NIES-2108 | NA |
| 112 | Amino acid sequence for RCJ35150.1 | *Nostoc punctiforme* NIES-2108 | AA |
| 113 | Coding sequence for WP_094352972.1 | *Nostoc* sp. '*Peltigera membranacea cyanobiont*' 210A | NA |
| 114 | Amino acid sequence for WP_094352972.1 | *Nostoc* sp. '*Peltigera membranacea cyanobiont*' 210A | AA |
| 115 | Coding sequence for WP_104909167.1 | *Nostoc* sp. '*Lobaria pulmonaria* (5183) *cyanobiont*' | NA |
| 116 | Amino acid sequence for WP 104909167.1 | *Nostoc* sp. '*Lobaria pulmonaria* (5183) *cyanobiont*' | AA |
| 117 | Coding sequence for WP_106217928.1 | *Cyanosarcina burmensis* | NA |
| 118 | Amino acid sequence for WP_106217928.1 | *Cyanosarcina burmensis* | AA |
| 119 | Coding sequence for WP_019498926.1 | *Pseudanabaena* sp. PCC 6802 | NA |
| 120 | Amino acid sequence for WP_019498926.1 | *Pseudanabaena* sp. PCC 6802 | AA |
| 121 | Coding sequence for WP_103124384.1 | *Nostoc cycadae* | NA |
| 122 | Amino acid sequence for WP_103124384.1 | *Nostoc cycadae* | AA |
| 123 | Coding sequence for BBD59026.1 | *Nostoc* sp. HK-01 | NA |
| 124 | Amino acid sequence for BBD59026.1 | *Nostoc* sp. HK-01 | AA |
| 125 | Coding sequence for WP_096579406.1 | *Anabaenopsis circularis* | NA |
| 126 | Amino acid sequence for WP_096579406.1 | *Anabaenopsis circularis* | AA |
| 127 | Coding sequence for WP_019504688.1 | *Pleurocapsa* sp. PCC 7319 | NA |
| 128 | Amino acid sequence for WP_019504688.1 | *Pleurocapsa* sp. PCC 7319 | AA |
| 129 | Coding sequence for OCQ98836.1 | *Nostoc* sp. MBR 210 | NA |
| 130 | Amino acid sequence for OCQ98836.1 | *Nostoc* sp. MBR 210 | AA |
| 131 | Coding sequence for WP_062293357.1 | *Nostoc piscinale* | NA |
| 132 | Amino acid sequence for WP_062293357.1 | *Nostoc piscinale* | AA |
| 133 | Coding sequence for WP_104398120.1 | *Microcystis aeruginosa* | NA |
| 134 | Amino acid sequence for WP_104398120.1 | *Microcystis aeruginosa* | AA |
| 135 | Coding sequence for WP_002758835.1 | *Microcystis aeruginosa* | NA |
| 136 | Amino acid sequence for WP_002758835.1 | *Microcystis aeruginosa* | AA |
| 137 | Coding sequence for WP_072927101.1 | *Microcystis aeruginosa* | NA |
| 138 | Amino acid sequence for WP 072927101.1 | *Microcystis aeruginosa* | AA |
| 139 | Coding sequence for WP_110578596.1 | *Microcystis aeruginosa* | NA |

TABLE 13-continued

| SEQ ID NO | Name | Source | Type |
|---|---|---|---|
| | Sequences described and used herein | | |
| 140 | Amino acid sequence for WP_110578596.1 | *Microcystis aeruginosa* | AA |
| 141 | Coding sequence for WP_045360762.1 | *Microcystis aeruginosa* | NA |
| 142 | Amino acid sequence for WP_045360762.1 | *Microcystis aeruginosa* | AA |
| 143 | Coding sequence for REJ48186.1 | *Microcystis flos-aquae* DF17 | NA |
| 144 | Amino acid sequence for REJ48186.1 | *Microcystis flos-aquae* DF17 | AA |
| 145 | Coding sequence for REJ50596.1 | *Microcystis aeruginosa* TA09 | NA |
| 146 | Amino acid sequence for REJ50596.1 | *Microcystis aeruginosa* TA09 | AA |
| 147 | Coding sequence for WP_041804209.1 | *Microcystis aeruginosa* | NA |
| 148 | Amino acid sequence for WP_041804209.1 | *Microcystis aeruginosa* | AA |
| 149 | Coding sequence for WP_004162848.1 | *Microcystis aeruginosa* | NA |
| 150 | Amino acid sequence for WP_004162848.1 | *Microcystis aeruginosa* | AA |
| 151 | Coding sequence for BAG04096.1 | *Microcystis aeruginosa* NIES-843 | NA |
| 152 | Amino acid sequence for BAG04096.1 | *Microcystis aeruginosa* NIES-843 | AA |
| 153 | Coding sequence for WP_002786802.1 | *Microcystis aeruginosa* | NA |
| 154 | Amino acid sequence for WP_002786802.1 | *Microcystis aeruginosa* | AA |
| 155 | Coding sequence for WP_002800102.1 | *Microcystis aeruginosa* | NA |
| 156 | Amino acid sequence for WP_002800102.1 | *Microcystis aeruginosa* | AA |
| 157 | Coding sequence for WP_002793167.1 | *Microcystis aeruginosa* | NA |
| 158 | Amino acid sequence for WP_002793167.1 | *Microcystis aeruginosa* | AA |
| 159 | Coding sequence for WP_061431977.1 | *Microcystis aeruginosa* | NA |
| 160 | Amino acid sequence for WP_061431977.1 | *Microcystis aeruginosa* | AA |
| 161 | Coding sequence for OUS02327.1 | *Gammaproteobacteria bacterium* 42_54_T18 | NA |
| 162 | Amino acid sequence for OUS02327.1 | *Gammaproteobacteria bacterium* 42_54_T18 | AA |
| 163 | Coding sequence for WP_106300061.1 | *Chamaesiphon polymorphus* | NA |
| 164 | Amino acid sequence for WP_106300061.1 | *Chamaesiphon polymorphus* | AA |
| 165 | Coding sequence for WP_099065794.1 | *Nostoc linckia* | NA |
| 166 | Amino acid sequence for WP_099065794.1 | *Nostoc linckia* | AA |
| 167 | Coding sequence for WP_012596348.1 | *Cyanothece* sp. PCC 8801 | NA |
| 168 | Amino acid sequence for WP_012596348.1 | *Cyanothece* sp. PCC 8801 | AA |
| 169 | Coding sequence for WP_036533591.1 | *Neosynechococcus sphagnicola* | NA |
| 170 | Amino acid sequence for WP_036533591.1 | *Neosynechococcus sphagnicola* | AA |
| 171 | Coding sequence for WP_015784471.1 | *Cyanothece* sp. PCC 8802 | NA |
| 172 | Amino acid sequence for WP_015784471.1 | *Cyanothece* sp. PCC 8802 | AA |
| 173 | Coding sequence for WP_094531790.1 | *Pseudanabaena* sp. SR411 | NA |
| 174 | Amino acid sequence for WP_094531790.1 | *Pseudanabaena* sp. SR411 | AA |
| 175 | Coding sequence for PZO42668.1 | *Pseudanabaena frigida* | NA |
| 176 | Amino acid sequence for PZO42668.1 | *Pseudanabaena frigida* | AA |
| 177 | Coding sequence for WP_106893977.1 | *Ahniella affigens* | NA |
| 178 | Amino acid sequence for WP_106893977.1 | *Ahniella affigens* | AA |
| 179 | Coding sequence for BBC22503.1 | *Pseudanabaena* sp. ABRG5-3 | NA |
| 180 | Amino acid sequence for BBC22503.1 | *Pseudanabaena* sp. ABRG5-3 | AA |
| 181 | Coding sequence for WP_055077131.1 | *Pseudanabaena* sp. '*Roaring Creek*' | NA |
| 182 | Amino acid sequence for WP_055077131.1 | *Pseudanabaena* sp. '*Roaring Creek*' | AA |
| 183 | Coding sequence for WP_009629598.1 | *Pseudanabaena biceps* | NA |
| 184 | Amino acid sequence for WP_009629598.1 | *Pseudanabaena biceps* | AA |
| 185 | Coding sequence for WP_015133151.1 | *Leptolyngbya* sp. PCC 7376 | NA |
| 186 | Amino acid sequence for WP_015133151.1 | *Leptolyngbya* sp. PCC 7376 | AA |
| 187 | Coding sequence for WP_063872765.1 | *Nodularia spumigena* | NA |
| 188 | Amino acid sequence for WP_063872765.1 | *Nodularia spumigena* | AA |
| 189 | Coding sequence for WP_096687527.1 | *Calothrix* sp. | NA |
| 190 | Amino acid sequence for WP_096687527.1 | *Calothrix* sp. | AA |
| 191 | Coding sequence for WP_015138267.1 | *Nostoc* sp. PCC 7524 | NA |

TABLE 13-continued

Sequences described and used herein

| SEQ ID NO | Name | Source | Type |
|---|---|---|---|
| 192 | Amino acid sequence for WP_015138267.1 | *Nostoc* sp. PCC 7524 | AA |
| 193 | Coding sequence for WP_094347473.1 | *Nostoc* sp. '*Peltigera membranacea cyanobiont*' 210A | NA |
| 194 | Amino acid sequence for WP_094347473.1 | *Nostoc* sp. '*Peltigera membranacea cyanobiont*' 210A | AA |
| 195 | Coding sequence for WP_012164252.1 | *Acaryochloris marina* | NA |
| 196 | Amino acid sequence for WP_012164252.1 | *Acaryochloris marina* | AA |
| 197 | Coding sequence for WP_015121985.1 | *Rivularia* sp. PCC 7116 | NA |
| 198 | Amino acid sequence for WP_015121985.1 | *Rivularia* sp. PCC 7116 | AA |
| 199 | Coding sequence for WP_038083060.1 | *Tolypothrix bouteillei* | NA |
| 200 | Amino acid sequence for WP_038083060.1 | *Tolypothrix bouteillei* | AA |
| 201 | Coding sequence for WP_006516541.1 | *Leptolyngbya* sp. PCC 7375 | NA |
| 202 | Amino acid sequence for WP_006516541.1 | *Leptolyngbya* sp. PCC 7375 | AA |
| 203 | Coding sequence for WP_099100980.1 | *Nostoc* sp. '*Peltigera malacea cyanobiont*' DB3992 | NA |
| 204 | Amino acid sequence for WP_099100980.1 | *Nostoc* sp. '*Peltigera malacea cyanobiont*' DB3992 | AA |
| 205 | Coding sequence for WP_096578311.1 | *Nostocales* | NA |
| 206 | Amino acid sequence for WP_096578311.1 | *Nostocales* | AA |
| 207 | Coding sequence for RCJ33284.1 | *Nostoc punctiforme* NIES-2108 | NA |
| 208 | Amino acid sequence for RCJ33284.1 | *Nostoc punctiforme* NIES-2108 | AA |
| 209 | Coding sequence for WP_052555973.1 | *Gemmata* sp. SH-PL17 | NA |
| 210 | Amino acid sequence for WP_052555973.1 | *Gemmata* sp. SH-PL17 | AA |
| 211 | Coding sequence for WP_103667398.1 | *Pseudanabaena* sp. BC1403 | NA |
| 212 | Amino acid sequence for WP_103667398.1 | *Pseudanabaena* sp. BC1403 | AA |
| 213 | Coding sequence for WP_023071825.1 | *Leptolyngbya* sp. *Heron Island J* | NA |
| 214 | Amino acid sequence for WP_023071825.1 | *Leptolyngbya* sp. *Heron Island J* | AA |
| 215 | Coding sequence for WP_096618242.1 | *Calothrix* sp. NIES-4101 | NA |
| 216 | Amino acid sequence for WP 096618242.1 | *Calothrix* sp. NIES-4101 | AA |
| 217 | Coding sequence for WP_107806740.1 | *Nodularia spumigena* | NA |
| 218 | Amino acid sequence for WP_107806740.1 | *Nodularia spumigena* | AA |
| 219 | Coding sequence for WP_017804222.1 | *Nodularia spumigena* | NA |
| 220 | Amino acid sequence for WP_017804222.1 | *Nodularia spumigena* | AA |
| 221 | Coding sequence for WP_010472182.1 | *Acaryochloris* sp. CCMEE 5410 | NA |
| 222 | Amino acid sequence for WP 010472182.1 | *Acaryochloris* sp. CCMEE 5410 | AA |
| 223 | Coding sequence for WP_103139451.1 | *Nostoc* sp. CENA543 | NA |
| 224 | Amino acid sequence for WP_103139451.1 | *Nostoc* sp. CENA543 | AA |
| 225 | Coding sequence for WP_075890025.1 | *Limnothrix rosea* | NA |
| 226 | Amino acid sequence for WP_075890025.1 | *Limnothrix rosea* | AA |
| 227 | Coding sequence for WP_050046589.1 | *Tolypothrix bouteillei* | NA |
| 228 | Amino acid sequence for WP_050046589.1 | *Tolypothrix bouteillei* | AA |
| 229 | Coding sequence for WP_012163949.1 | *Acaryochloris marina* | NA |
| 230 | Amino acid sequence for WP_012163949.1 | *Acaryochloris marina* | AA |
| 231 | Coding sequence for WP_050046033.1 | *Tolypothrix bouteillei* | NA |
| 232 | Amino acid sequence for WP_050046033.1 | *Tolypothrix bouteillei* | AA |
| 233 | Coding sequence for WP_096660823.1 | *Calothrix parasitica* | NA |
| 234 | Amino acid sequence for WP_096660823.1 | *Calothrix parasitica* | AA |
| 235 | Coding sequence for WP_110989156.1 | *Acaryochloris* sp. RCC1774 | NA |
| 236 | Amino acid sequence for WP_096660823.1 | *Calothrix parasitica* | AA |
| 237 | Coding sequence for WP_010473598.1 | *Acaryochloris* sp. CCMEE 5410 | NA |
| 238 | Amino acid sequence for WP_010473598.1 | *Acaryochloris* sp. CCMEE 5410 | AA |
| 239 | Amino acid sequence for 5MEE_A | *Cyanothece* sp. PCC 8801 | AA |

TABLE 13-continued

| SEQ ID NO | Name | Source | Type |
|---|---|---|---|
| | Sequences described and used herein | | |
| | Consensus Motifs | | |
| 240 | Consensus sequence motif | artificial | AA |
| 241 | Consensus sequence motif | artificial | AA |
| 242 | Consensus sequence motif | artificial | AA |
| 243 | Consensus sequence motif | artificial | AA |
| 244 | Consensus sequence motif | artificial | AA |
| 245 | Consensus sequence motif | artificial | AA |
| 246 | Consensus sequence motif | artificial | AA |
| 247 | Consensus sequence motif | artificial | AA |
| 248 | Consensus sequence motif | artificial | AA |
| 249 | Consensus sequence motif | artificial | AA |
| 250 | Consensus sequence motif | artificial | AA |
| 251 | Consensus sequence motif | artificial | AA |
| 252 | Consensus sequence motif | artificial | AA |
| | Mutants of bacterial LOX | | |
| 253 | Codon-optimized coding sequence for WP_002738122.1mut | artificial | NA |
| 254 | Amino acid sequence for WP_002738122.1mut | artificial | AA |
| 255 | Codon-optimized coding sequence for WP_002738122.1mut2 | artificial | NA |
| 256 | Amino acid sequence for WP_002738122.1mut2 | artificial | AA |
| 257 | Codon-optimized coding sequence for WP_015204462.1mut | artificial | NA |
| 258 | Amino acid sequence for WP_015204462.1mut | artificial | AA |
| 259 | Codon-optimized coding sequence for WP_015204462.1mut2 | artificial | NA |
| 260 | Amino acid sequence for WP_015204462.1mut2 | artificial | AA |
| 261 | Codon-optimized coding sequence for WP_015204462.1mut3 | artificial | NA |
| 262 | Amino acid sequence for WP_015204462.1mut3 | artificial | AA |
| 263 | Codon-optimized coding sequence for WP_006635899.1mut | artificial | NA |
| 264 | Amino acid sequence for WP_006635899.1mut | artificial | AA |
| 265 | Codon-optimized coding sequence for WP_015178512.1mut | artificial | NA |
| 266 | Amino acid sequence for WP_015178512.1mut | artificial | AA |
| 267 | Codon-optimized coding sequence for WP_028091425.1mut | artificial | NA |
| 268 | Amino acid sequence for WP_028091425.1mut | artificial | AA |
| 269 | Codon-optimized coding sequence for OBQ01436.1mut | artificial | NA |
| 270 | Amino acid sequence for OBQ01436.1mut | artificial | AA |
| 271 | Codon-optimized coding sequence for OBQ25779.1mut | artificial | NA |
| 272 | Amino acid sequence for OBQ25779.1mut | artificial | AA |
| 273 | Codon-optimized coding sequence for WP_039200563.1mut | artificial | NA |
| 274 | Amino acid sequence for WP_039200563.1mut | artificial | AA |
| 275 | Codon-optimized coding sequence for WP_012407347.1mut | artificial | NA |
| 276 | Amino acid sequence for WP_012407347.1mut | artificial | AA |
| 277 | Codon-optimized coding sequence for WP_027843955.1mut | artificial | NA |
| 278 | Amino acid sequence for WP_027843955.1mut | artificial | AA |
| 279 | Codon-optimized coding sequence for WP_073641301.1mut | artificial | NA |
| 280 | Amino acid sequence for WP_073641301.1mut | artificial | AA |
| 281 | Codon-optimized coding sequence for WP_096647440.1mut | artificial | NA |

TABLE 13-continued

| Sequences described and used herein | | | |
|---|---|---|---|
| SEQ ID NO | Name | Source | Type |
| 282 | Amino acid sequence for WP_096647440.1mut | artificial | AA |
| 283 | Codon-optimized coding sequence for WP_099099431.1mut | artificial | NA |
| 284 | Amino acid sequence for WP_099099431.1mut | artificial | AA |
| 285 | Codon-optimized coding sequence for WP_052672367.1mut | artificial | NA |
| 286 | Amino acid sequence for WP_052672367.1mut | artificial | AA |
| 287 | Codon-optimized coding sequence for WP_073631249.1mut | artificial | NA |
| 288 | Amino acid sequence for WP_073631249.1mut | artificial | AA |
| 289 | Codon-optimized coding sequence for WP_013220336.1mut | artificial | NA |
| 290 | Amino acid sequence for WP_013220336.1mut | artificial | AA |

NA = Nucleic Acid Sequence
AA = Amino Acid Sequence

Remarks on the Above Listing:

SEQ ID NO: 59-74 refer to the corresponding natural coding sequences for SEQ ID NO: 20, 22, 24, 26, 28, 30, 32, 34, 36, 38, 40, 42, 44, 46, 48, 50

SEQ ID NO: 75-238 are a pairwise representation of the corresponding putative coding sequences (the start codon changed to “ATG” for the sequences which don’t have “ATG”; sequence not codon optimized, therefore considered as “natural” except for start codon) and the amino acid Sequences for the mined LOX mined from NCBI SEQ ID NO: 239—the amino acid sequence for 5MEE_A mined from NCBI SEQ ID NO: 253-290 refer to mutants of bacterial LOX:

Encompassed within the general disclosure of the present description is any coding nucleic acid described herein without a 5'-terminal start codon triplet or with an artificial or natural start codon triplet.

1. CoLOX

Coding sequence for CoLOX-3

SEQ ID NO: 1

```
ATGACGTCGTCTCCGACCGTCAGATCGATGGTAATGCTGGCCGTGCTGGCCGTCTCTGCCCTGGAGAGCGCGC

CCTGCGCCTCGGCCTTTGCCACGCTCCCCCGCGCCCTCGTACGACCGCAAGCCGCCCTCAAGTACCGAGCCGA

GGACAAAAATGACGTCGATGTCGCCCCGGCTGGTAGCACTGCCTCCGACGTGAGCAAGCCCGAAGGCAAGG

CCACCGCCGTCGCCAAGGGTACTGTCAACGCGCCCATCGAGGAGGCATGGAAGGTCTTCCGGTCTTTTTCCAA

CATGAACCAATGGATGCCCGTGTACGGCGAGTGGGAGGCCACGGGAGACTCAGTCGGAGACACCCGCACGT

TCAACTTCAAGGATCAGCCGACCTTCTTCACTACCGAGAGGCTTGTCGGCCTGGACGACTCCCAGTACAAGAT

GAAGTACACCCTCGTCAACTGCAAGGGCTCGCCCGTGCCCATCGAATCTATCGACACCATCGTCACCTTCACTG

CAAACGATGATGTGACCGAGGTTGACTGGCGCTCCTGGACGAAGTCGCCCATGGTCGACTTGATCAAGGGAC

GTCAGGCGGCCGGGTATGCCGGCGGCATCGCAGCGCTCGACCGGTACCTGAACCCGTCCCTTGGCACCGTCG

ATGTCACCATCAAGTCGGCCGACAACCTCGATGGTGATTTCCTGTCCAGCTCCTACGCCACTCTCATGGTCACG

GACGCCGACCCCGAGCAAGTGCATGCCAAGGAGTGGGGGACGAGTCCTGAGTTTGATGCCAAGCCCGTCCA

GTTCAGCCTGCTCAAGCCCGACTCCAAGCTCTACATGAGCGTCATGCTGACCAAGTGCGGCGTCGACGCCCCC

GTCGGATACGCCGTCTTTGACATCCAGAAGAGCCTCAAGTCCGGCGAGACTGTGACCGAGACCTTTCAGCTCG

AGGGCAGCAACGATGCAACGTTGACGGTCGAGATGGAGCTCAACCTCCGGCAGGGCAGCATCCTCCCTCAAT

CCAAGGCCCAGAAGAATCTGGCGACCCTTGTCGCCCTCCAGCAGTCTGTCGAGAGGGTCCGAGACCGCATCG

TTACTATCGGCAAGCTGGCCGGCGAGCCCGAGAAGTCGGTATGGGAGTACGAGCGAAAGTCCGGCCTTCCCA

AGTCCGTCAAGGGCCTTCCTCGGTCGGAAGTGCTGCCGCCGCACAAGATCGCCCTCATGGTCGACGCCATCGC
```

-continued

CGAGTACGCTTACACCCAGTTCCAGCTCGTCCAGCGCCTGCTCCCCGTCAGAAACTCGTACGACCGGTACGCC

GCTTACTTTGCCCCAGAAGGCGAGGAGTACGTTCCCATCCCGCAGATCCTCAAGGACATGACGTGGTCCACCG

ATGACGAGTTCATCCGCCAGATCTTCGCCGGCCTCAACCCTTTGCAAGTCGAGGTCGTCAAGAACAAGGCCGG

TCTGCCCTCCAAGTTGCAGGAGCTCAAGGCCAGGGACGGATCTGATGTCGATAAGCTCATCTCGGAAGGCCG

GTTGTATGTTCTGGACTACTCGGTCCTCAAGGATCTCGACCTCAACCGCAACGGTGTCACCCTGTACGCGCCGA

CGATGCTCATCTACCGCACTGGTGGTGACAAGCTCGACGTCCTCGGCATCATGCTCGAGCCCCGCCGTGACGA

TGCGCCCGTTTACACGCCCGACTCTGAAACTCCCAACAAGTTCCTTCTCGCCAAGTGCCACGTTGCCTGCGCTG

ACAACCAAGTGCACCAGTTCACGTACCATCTCGGTTACGCCCATCTTGCCACGGAGCCACTTGCGATCGCAAG

CCACAACGTCCTGGAGAAGAACAGCCATCCGCTCGGCATGTTCCTCAAGCCACACTTCCGCGACAACATTGGC

ATCAACTACCTCGCCCGGCAGACTCTTGTTGCCGACGAAGACGCCATCACAGACCACACCTTTGCCACGGGCA

CCGCGCAGGGCGTCAGTATGGTCGTCGACGCCTTCAAGTCGTACAACTTCCTCGAGTCTGGCTTGCCCGATGA

GCTGCGCCGTCGTGGATTCGAACGGTCGGACGACCTCAAGGTGTATCGCTACCGCGACGATGGCTGGTTGGT

TTGGGACACGCTCTGGAAGTACGCCGAGGATATGGTCAACGAGCTGTACGGAACGGACAACGATGTCACTGC

TGACAAGGTCGTCCAGGAGTGGGCGAGGGAAGCATCTGGCTCGGACACTGCCGACGTCCAGGGCTTTCCGG

AGTCCATCACGACCAAGTACATCCTCACAAAGGTCCTGACGACGATCATCTGGCAAGCGTCCGCCTTGCACTC

GGCTCTCAACTACATCCAATACCCGTACACTGCGACCCCCATCAACCGTGCCGCCTCCATCTTTGGACCGGTCC

CTGACGGCGAAGCGGATATCACCGAGCAGGACATCCTGGATGTCATCCCTGGTGGTCTGGACGATGAGAACA

ACCGTGGTCTGACCCTCTCCATCTTCCAAGGCCTGCTCTCGTGGCTCCTGCGCACTCCTGAGAACCCGACGCTG

GACGAAGTCGGCAGCCCAATCCCGAACAGGAACAACCCCATCGAGTGGGTCGAGTTCCGCTCGAAGTACCCC

CAGGTCTACTACAACTTGGACCAGAACCTTGCCGTGGTGGAGAAGATCATCGAGGAGCGCAACAAGGGCCTT

GCTTCTCCGTACGAGGTGCTCCTTCCCAGCCACATTGCTGCCAGCATCAACATCTGA

Codon-optimized coding sequence of CoLOX-3 by Genscript genetic codon frequency of *E. coli*

SEQ ID NO: 2

ATGACCAGCAGCCCGACCGTGCGTAGCATGGTTATGCTGGCGGTTCTGGCGGTTAGCGCGCTGGAAAGCGCG

CCGTGCGCGAGCGCGTTTGCGACCCTGCCGCGTGCGCTGGTTCGTCCGCAGGCGGCGCTGAAGTATCGTGCG

GAAGACAAAAACGATGTTGATGTTGCGCCGGCGGGTAGCACCGCGAGCGATGTTAGCAAGCCGGAGGGTAA

AGCGACCGCGGTTGCGAAGGGCACCGTGAACGCGCCGATCGAGGAAGCGTGGAAAGTGTTCCGTAGCTTTA

GCAACATGAACCAATGGATGCCGGTTTACGGCGAGTGGGAAGCGACCGGTGACAGCGTGGGCGATACCCGT

ACCTTCAACTTTAAGGACCAGCCGACCTTCTTTACCACCGAGCGTCTGGTGGGTCTGGACGATAGCCAATATA

AGATGAAATACACCCTGGTTAACTGCAAAGGCAGCCCGGTGCCGATCGAAAGCATTGATACCATCGTTACCTT

CACCGCGAACGACGATGTGACCGAGGTTGACTGGCGTAGCTGGACCAAGAGCCCGATGGTGGATCTGATTAA

AGGTCGTCAAGCGGCGGGTTATGCGGGTGGCATTGCGGCGCTGGACCGTTACCTGAACCCGAGCCTGGGCAC

CGTGGACGTTACCATCAAGAGCGCGGATAACCTGGACGGCGATTTCCTGAGCAGCAGCTACGCGACCCTGAT

GGTTACCGATGCGGATCCGGAGCAGGTGCATGCGAAGGAATGGGGCACCAGCCCGGAGTTCGACGCGAAAC

CGGTTCAATTTAGCCTGCTGAAGCCGGATAGCAAACTGTATATGAGCGTGATGCTGACCAAATGCGGTGTGG

ATGCGCCGGTTGGTTATGCGGTGTTCGATATTCAGAAGAGCCTGAAAAGCGGCGAGACCGTTACCGAAACCT

TTCAACTGGAAGGCAGCAACGACGCGACCCTGACCGTGGAGATGGAACTGAACCTGCGTCAGGGTAGCATCC

TGCCGCAGAGCAAGGCGCAGAAGAACCTGGCGACCCTGGTTGCGCTGCAGCAAAGCGTGGAGCGTGTTCGT

GACCGTATTGTTACCATCGGTAAACTGGCGGGTGAACCGGAGAAGAGCGTGTGGGAGTATGAGCGTAAGAG

CGGTCTGCCGAAGAGCGTTAAAGGTCTGCCGCGTAGCGAAGTGCTGCCGCCGCACAAAATTGCGCTGATGGT

TGACGCGATCGCGGAGTACGCGTATACCCAGTTCCAACTGGTTCAGCGTCTGCTGCCGGTGCGTAACAGCTAC

-continued

GACCGTTATGCGGCGTACTTTGCGCCGGAAGGCGAGGAATACGTGCCGATTCCGCAAATCCTGAAGGATATG

ACCTGGAGCACCGACGATGAGTTCATTCGTCAGATCTTTGCGGGTCTGAACCCGCTGCAAGTTGAAGTGGTTA

AGAACAAAGCGGGTCTGCCGAGCAAGCTGCAGGAGCTGAAAGCGCGTGACGGTAGCGACGTGGATAAGCTG

ATCAGCGAGGGCCGTCTGTATGTTCTGGATTACAGCGTGCTGAAAGACCTGGATCTGAACCGTAACGGTGTTA

CCCTGTATGCGCCGACCATGCTGATTTACCGTACCGGTGGCGACAAACTGGATGTTCTGGGCATCATGCTGGA

ACCGCGTCGTGACGATGCGCCGGTGTACACCCCGGACAGCGAGACCCCGAACAAGTTCCTGCTGGCGAAATG

CCACGTTGCGTGCGCGGATAACCAGGTGCACCAATTTACCTATCACCTGGGTTATGCGCACCTGGCGACCGAA

CCGCTGGCGATTGCGAGCCACAACGTGCTGGAGAAGAACAGCCACCCGCTGGGCATGTTCCTGAAACCGCAC

TTTCGTGACAACATCGGCATTAACTATCTGGCGCGTCAGACCCTGGTTGCGGACGAAGATGCGATCACCGATC

ATACCTTTGCGACCGGCACCGCGCAAGGCGTGAGCATGGTGGTTGACGCGTTCAAGAGCTACAACTTTCTGG

AAAGCGGTCTGCCGGATGAGCTGCGTCGTCGTGGTTTCGAGCGTAGCGACGATCTGAAGGTTTACCGTTATC

GTGACGATGGTTGGCTGGTGTGGGACACCCTGTGGAAATATGCGGAGGATATGGTTAACGAACTGTACGGCA

CCGACAACGATGTGACCGCGGACAAAGTGGTTCAGGAGTGGGCGCGTGAAGCGAGCGGTAGCGACACCGCG

GATGTTCAAGGCTTCCCGGAAAGCATTACCACCAAGTATATCCTGACCAAAGTGCTGACCACCATCATTTGGC

AAGCGAGCGCGCTGCACAGCGCGCTGAACTACATTCAATACCCGTATACCGCGACCCCGATTAACCGTGCGGC

GAGCATCTTTGGTCCGGTTCCGGACGGCGAGGCGGATATTACCGAACAGGACATTCTGGATGTGATCCCGGG

TGGCCTGGACGATGAGAACAACCGTGGTCTGACCCTGAGCATCTTCCAAGGTCTGCTGAGCTGGCTGCTGCGT

ACCCCGGAAAACCCGACCCTGGACGAGGTTGGTAGCCCGATTCCGAACCGTAACAACCCGATCGAGTGGGTT

GAATTTCGTAGCAAGTATCCGCAGGTGTACTATAACCTGGATCAAAACCTGGCGGTGGTTGAAAAGATCATTG

AGGAACGTAACAAAGGTCTGGCGAGCCCGTACGAGGTGCTGCTGCCGAGCCACATTGCGGCGAGCATCAAC

ATTTAA

Amino acid Sequence for CoLOX-3

SEQ ID NO: 3

MTSSPTVRSMVMLAVLAVSALESAPCASAFATLPRALVRPQAALKYRAEDKNDVDVAPAGSTASDVSKPEGKATA

VAKGTVNAPIEEAWKVFRSFSNMNQWMPVYGEWEATGDSVGDTRTFNFKDQPTFFTTERLVGLDDSQYKMKY

TLVNCKGSPVPIESIDTIVTFTANDDVTEVDWRSWTKSPMVDLIKGRQAAGYAGGIAALDRYLNPSLGTVDVTIKSA

DNLDGDFLSSSYATLMVTDADPEQVHAKEWGTSPEFDAKPVQFSLLKPDSKLYMSVMLTKCGVDAPVGYAVFDI

QKSLKSGETVTETFQLEGSNDATLTVEMELNLRQGSILPQSKAQKNLATLVALQQSVERVRDRIVTIGKLAGEPEKSV

WEYERKSGLPKSVKGLPRSEVLPPHKIALMVDAIAEYAYTQFQLVQRLLPVRNSYDRYAAYFAPEGEEYVPIPQILKD

MTWSTDDEFIRQIFAGLNPLQVEVVKNKAGLPSKLQELKARDGSDVDKLISEGRLYVLDYSVLKDLDLNRNGVTLYA

PTMLIYRTGGDKLDVLGIMLEPRRDDAPVYTPDSETPNKFLLAKCHVACADNQVHQFTYHLGYAHLATEPLAIASH

NVLEKNSHPLGMFLKPHFRDNIGINYLARQTLVADEDAITDHTFATGTAQGVSMVVDAFKSYNFLESGLPDELRRR

GFERSDDLKVYRYRDDGWLVWDTLWKYAEDMVNELYGTDNDVTADKVVQEWAREASGSDTADVQGFPESITT

KYILTKVLTTIIWQASALHSALNYIQYPYTATPINRAASIFGPVPDGEADITEQDILDVIPGGLDDENNRGLTLSIFQGLL

SWLLRTPENPTLDEVGSPIPNRNNPIEWVEFRSKYPQVYYNLDQNLAVVEKIIEERNKGLASPYEVLLPSHIAASINI

Coding sequence for CoLOX-0317

SEQ ID NO: 4

ATGACGTCGTCTCCGACCGTCAGATCGATGGTAATGCTGGCCGTGCTGGCCGTCTATGCCCTGGAGAGCACGC

CCTGCGCCTCGGCCTTTGCCACGCTCCCCCGCGCCCTCGTACGACCGCAAGCCGCCCTCAAGTACCGAGCCGA

GGACAAAAACGACGTCGATGTCGCCCCGGCTGGTAGCACTGCCTCCGACGTGAGCAAGCCCGAAGGCAAGG

CCACCGCCGTCGCCAAGGGTACGGTCAACGCGCCCATCGAGGAGGCATGGAAGGTCTTCCGGTCTTTTTCCAA

CATGAACCAATGGATGCCCGTGTACGGCGAGTGGGAGGCCACGGGAGACTCCGTCGGAGACACCCGCACGT

TCAACTTCAAGGATCAGCCGACCTTCTTCACTACCGAGAGGCTTGTCGGCCTGGACGACTCCCAGTACAAGAT

-continued

GAAGTACACCCTCGTCAACTGCAAGGGCTCGCCCGTGCCCATCGAATCTATCGACACCATCGTCACCTTCACTG

CAAACGATGATGTGACCGAGGTTGACTGGCGCTCCTGGACGAAGTCGCCCATGGTCGACTTGATCAAGGGAC

GCCAGGCGGCCGGGTATGCCGGCGGCATCGCAGCGCTCGACCGGTACCTGAACCCGTCCCTTGGCACCGTCG

ATGTCACCATCAAGTCGGCCGACAACCTCGATGGCAATTTCCTGTCCAGCTCCTACGCCACTCTCATGGTCACG

GACGCCGACCCCGAGCAAGTGCATGCCAAGGAGTGGGGACGAGTCCTGAGTTTGATGCCAAGCCCGTCCA

GTTCAGCCTGCTCAAGCCCGACTCCAAGCTCTACATGAGCGTCATGCTGACCAAGTACGGCGTCGACACGCCC

GTCGGATACGCCGTCTTTGACATCCAGAAGAGCCTCAAGTCCGGCGAGACTGTGACCGAGACCTTTCAGCTCG

AGGGCAGCAACGATGCAACGTTGACGGTCGAGATGGAGCTCAACCTCCGACAGGGCAGCGTCCTCCCTCAAT

CCAAGGCCCAGAAGAATCTGGCGACCCTTGTCGCCCTCCAGCAGTCTGTCGAGAGGGTCCGAGACCGCATCG

TTACTATCGGCAAGCTGGCCGGCGAGCCCGAGAAGTCGGTATGGGAGTACGAGCGAAAGTCCGGCCTTCCCA

AGTCCGTCAAGGGCCTTCCTCGGTCGGAAGTGCTGCCGCCGCACAAGATCGCCCTCATGGTCGACGCCATCGC

CGAGTACGCTTACACTCAGTTCCAGCTCGTCCAGCGCCTGCTCCCCGTCAGAAACTCGTACGACCGGTACGCC

GCTTACTTTGCCCCAGAAGGCGAGGAATACGTTCCCATCCCGCAGATCCTCAAGGACATGACGTGGTCCACCG

ATGACGAGTTCATCCGCCAGATCTTTGCCGGCCTCAACCCGTTGCAAGTCGAGGTCGTCAAGAACAAGGCCGG

TCTGCCCTCCAAGTTGCAGGAGCTCAAGGCCAAGGACGGATCTGATGTCGATAAGCTCATCTCGGAAGGCCG

GTTGTATGTTCTGGACTACTCGGTCCTCAAGGATCTCGACCTCGACCGCAACGGTGTCACCCTGTACGCGCCG

ACGATGCTCATCTACCGCACTGGTGGTGACAAGCTCGACGTCCTCGGCATCATGCTTGAGCCCCGCCGTGACG

ACGCGCCCGTTTACACGCCCGACTCTGAAACTCCCAACAAGTTCCTTCTCGCCAAGTGCCACGTTGCCTGCGCT

GACAACCAAGTGCACCAGTTCACGTACCATCTCGGTTACGCCCATCTTGCCACAGAGCCACTTGCGATTGCAA

GCCACAACGTCCTGGAGAAGAACAGCCATCCGCTCGGCATGTTCCTCAAGCCACACTTCCGCGACAACATCGG

CATCAACTACCTCGCCCGACAGACTCTTGTTGCCGACGAAGACGCCATCACAGACCACACCTTTGCCACGGGC

ACCGCGCAGGGCGTCAGTATGGTCGTCGACGCCTTCAAGTCGTACAACTTCCTCGAGTCTGGCTTGCCCGATG

AGCTGCGCCGTCGTGGATTCGAACGGTCGGACGACCTCAAGGTGTATCGCTACCGCGACGATGGCTGGTTGA

TCTGGGACACGCTCTGGAAGTACGCCGAGGATATGGTCAACGAGCTGTACGGAACGGACAACGATGTCGCTG

CTGACAAGGTCGTCCAGGAGTGGGCGAAGGAAGCATCTGGCTCGGACACTGCCGACGTCCAGGGCTTTCCGG

AGTCCATCACGACCAAGTACATCCTCACAAAGGTCCTGACGACGATCATCTGGCAAGCGTCCGCCTTGCACTC

GGCTCTCAACTACATCCAATACCCGTACACTGCGACCCCCATCAACCGTGCCGCCTCCATCTTTGGACCGGTCC

CTGACGGCGAAGCGGATATCACCGAGCAGGACATCCTGGATGTCATCCCTGGTGGTCTGGACGATGAGAACA

ACCGTGGTCTGACCCTCTCCATCTTCCAAGGCCTGCTCTCGTGGCTCCTGCGCACTCCTGAGAACCCGACGCTG

GACGAAGTCGGCAGCCCAATCCCGAACAGGAACAACCCCATCGAGTGGGTCGAGTTCCGCTCGAAGTACCCC

CAGGTCTACTACAACTTGGACCAGAACCTTGCCGTGGTGGAGAAGATCATCGAGGAGCGCAACAAGGGCCTT

GCTTCTCCGTACGAGGTGCTCCTTCCCAGCCACATTGCTGCCAGCATCAACATCTGA

Codon-optimized coding sequence of CoLOX-0317 by Genscript genetic codon frequency of *E. coli*
SEQ ID NO: 5

ATGACCAGCAGCCCGACCGTGCGTAGCATGGTTATGCTGGCGGTGCTGGCGGTTTATGCGCTGGAAAGCACC

CCGTGCGCGAGCGCGTTTGCGACCCTGCCGCGTGCGCTGGTTCGTCCGCAGGCGGCGCTGAAGTATCGTGCG

GAAGATAAAAACGATGTGGATGTGGCGCCGGCGGGTAGCACCGCGAGCGACGTTAGCAAGCCGGAGGGTA

AAGCGACCGCGGTTGCGAAGGGCACCGTGAACGCGCCGATCGAGGAAGCGTGGAAAGTGTTCCGTAGCTTT

AGCAACATGAACCAATGGATGCCGGTTTACGGCGAGTGGGAAGCGACCGGTGATAGCGTGGGCGACACCCG

TACCTTCAACTTTAAGGATCAGCCGACCTTCTTTACCACCGAGCGTCTGGTGGGTCTGGACGATAGCCAATATA

AGATGAAATACACCCTGGTTAACTGCAAAGGCAGCCCGGTGCCGATCGAAAGCATTGACACCATCGTTACCTT

-continued

CACCGCGAACGACGATGTGACCGAGGTTGATTGGCGTAGCTGGACCAAGAGCCCGATGGTGGACCTGATTAA

AGGTCGTCAAGCGGCGGGTTATGCGGGTGGCATTGCGGCGCTGGATCGTTATCTGAACCCGAGCCTGGGCAC

CGTGGACGTTACCATTAAGAGCGCGGATAACCTGGACGGCAACTTCCTGAGCAGCAGCTACGCGACCCTGAT

GGTTACCGATGCGGATCCGGAGCAGGTGCATGCGAAGGAATGGGGCACCAGCCCGGAGTTCGATGCGAAAC

CGGTTCAATTTAGCCTGCTGAAGCCGGACAGCAAACTGTATATGAGCGTGATGCTGACCAAATACGGTGTGG

ATACCCCGGTTGGCTATGCGGTGTTCGACATCCAGAAGAGCCTGAAAAGCGGCGAGACCGTTACCGAAACCT

TTCAACTGGAAGGCAGCAACGACGCGACCCTGACCGTTGAGATGGAACTGAACCTGCGTCAGGGTAGCGTGC

TGCCGCAGAGCAAGGCGCAGAAGAACCTGGCGACCCTGGTGGCGCTGCAGCAAAGCGTGGAGCGTGTTCGT

GACCGTATTGTTACCATCGGTAAACTGGCGGGTGAACCGGAGAAGAGCGTGTGGGAGTACGAGCGTAAGAG

CGGTCTGCCGAAGAGCGTTAAAGGTCTGCCGCGTAGCGAAGTGCTGCCGCCGCACAAAATTGCGCTGATGGT

TGACGCGATCGCGGAGTACGCGTATACCCAGTTCCAACTGGTTCAGCGTCTGCTGCCGGTGCGTAACAGCTAC

GATCGTTATGCGGCGTACTTTGCGCCGGAAGGCGAGGAATACGTGCCGATTCCGCAAATCCTGAAGGACATG

ACCTGGAGCACCGACGATGAGTTCATTCGTCAGATCTTTGCGGGTCTGAACCCGCTGCAAGTTGAAGTGGTTA

AGAACAAAGCGGGTCTGCCGAGCAAGCTGCAGGAGCTGAAGGCGAAAGATGGTAGCGACGTGGATAAACTG

ATCAGCGAGGGCCGTCTGTATGTTCTGGACTACAGCGTGCTGAAGGACCTGGATCTGGACCGTAACGGTGTT

ACCCTGTATGCGCCGACCATGCTGATTTACCGTACCGGTGGCGATAAACTGGACGTTCTGGGCATCATGCTGG

AACCGCGTCGTGACGATGCGCCGGTGTACACCCCGGATAGCGAGACCCCGAACAAGTTCCTGCTGGCGAAAT

GCCACGTTGCGTGCGCGGACAACCAGGTGCACCAATTTACCTATCACCTGGGTTATGCGCACCTGGCGACCGA

ACCGCTGGCGATTGCGAGCCACAACGTGCTGGAGAAGAACAGCCACCCGCTGGGCATGTTCCTGAAACCGCA

CTTTCGTGATAACATCGGCATTAACTACCTGGCGCGTCAGACCCTGGTTGCGGATGAAGACGCGATCACCGAT

CATACCTTTGCGACCGGCACCGCGCAAGGCGTGAGCATGGTGGTTGATGCGTTCAAGAGCTATAACTTTCTGG

AAAGCGGTCTGCCGGATGAGCTGCGTCGTCGTGGTTTCGAGCGTAGCGACGATCTGAAGGTTTACCGTTATC

GTGACGATGGTTGGCTGATTTGGGATACCCTGTGGAAATACGCGGAGGACATGGTTAACGAACTGTATGGCA

CCGATAACGACGTGGCGGCGGACAAGGTGGTTCAGGAGTGGGCGAAAGAAGCGAGCGGTAGCGATACCGC

GGACGTTCAAGGCTTCCCGGAAAGCATTACCACCAAGTACATCCTGACCAAAGTGCTGACCACCATCATTTGG

CAAGCGAGCGCGCTGCACAGCGCGCTGAACTATATCCAATACCCGTATACCGCGACCCCGATTAACCGTGCGG

CGAGCATCTTTGGTCCGGTTCCGGATGGCGAGGCGGACATTACCGAACAGGATATTCTGGACGTGATCCCGG

GTGGCCTGGACGATGAGAACAACCGTGGTCTGACCCTGAGCATCTTCCAAGGTCTGCTGAGCTGGCTGCTGC

GTACCCCGGAAAACCCGACCCTGGATGAGGTTGGTAGCCCGATTCCGAACCGTAACAACCCGATCGAGTGGG

TTGAATTTCGTAGCAAATACCCGCAGGTGTACTATAACCTGGACCAAAACCTGGCGGTGGTTGAAAAGATCAT

TGAGGAACGTAACAAAGGCCTGGCGAGCCCGTATGAGGTGCTGCTGCCGAGCCACATTGCGGCGAGCATCA

ACATTTAA

Amino acid Sequence for CoLOX-0317

SEQ ID NO: 6

MTSSPTVRSMVMLAVLAVYALESTPCASAFATLPRALVRPQAALKYRAEDKNDVDVAPAGSTASDVSKPEGKATA

VAKGTVNAPIEEAWKVFRSFSNMNQWMPVYGEWEATGDSVGDTRTFNFKDQPTFFTTERLVGLDDSQYKMKY

TLVNCKGSPVPIESIDTIVTFTANDDVTEVDWRSWTKSPMVDLIKGRQAAGYAGGIAALDRYLNPSLGTVDVTIKSA

DNLDGNFLSSSYATLMVTDADPEQVHAKEWGTSPEFDAKPVQFSLLKPDSKLYMSVMLTKYGVDTPVGYAVFDIQ

KSLKSGETVTETFQLEGSNDATLTVEMELNLRQGSVLPQSKAQKNLATLVALQQSVERVRDRIVTIGKLAGEPEKSV

WEYERKSGLPKSVKGLPRSEVLPPHKIALMVDAIAEYAYTQFQLVQRLLPVRNSYDRYAAYFAPEGEEYVPIPQILKD

MTWSTDDEFIRQIFAGLNPLQVEVVKNKAGLPSKLQELKAKDGSDVDKLISEGRLYVLDYSVLKDLDLDRNGVTLYA

PTMLIYRTGGDKLDVLGIMLEPRRDDAPVYTPDSETPNKFLLAKCHVACADNQVHQFTYHLGYAHLATEPLAIASH

-continued

NVLEKNSHPLGMFLKPHFRDNIGINYLARQTLVADEDAITDHTFATGTAQGVSMVVDAFKSYNFLESGLPDELRRR

GFERSDDLKVYRYRDDGWLIWDTLWKYAEDMVNELYGTDNDVAADKVVQEWAKEASGSDTADVQGFPESITTK

YILTKVLTTIIWQASALHSALNYIQYPYTATPINRAASIFGPVPDGEADITEQDILDVIPGGLDDENNRGLTLSIFQGLLS

WLLRTPENPTLDEVGSPIPNRNNPIEWVEFRSKYPQVYYNLDQNLAVVEKIIEERNKGLASPYEVLLPSHIAASINI

Coding sequence for CoLOX-19

SEQ ID NO: 7

ATGACGTCGTCTCCGACCGTCAGATCGATGGTAATGCTGGCCGTGCTGGCCGTCTCTGCCCTGGAGAGCGCGC

CCTGCGCCTCGGCCTTTGCCACGCTCCCCCGCGCCCTCGTACGACCGCAAGCCGCCCTCAAGTACCGAGCCGA

GGACAAAAACGACGTCGATGTCGCCCCGGCTGGTAGCACTGCCTCCGACGTGAGCAAGCCCGAAGGAAAGG

CCACTGCTGTCGCCAAGGGTACTGTCAACGCGCCCATCGAGGAGGCATGGAAGGTCTTCCGGTCTTTTTCCAA

CATGGACCAATGGATGCCCGTGTACGGCGAGTGGGAGGCCACGGGAGACTCAGTCGGAGACACCCGCACGT

TCAACTTCAAGGATCAGCCGACCTTCTTCACTACCGAGAGGCTTGTCGGCCTGGACGACTCCCAGTACAAGAT

GAAGTACACCCTCGTCGACTGCAAGGGCTCGCCCGTGCCCATCGAATCTATTGACACCATCGTCACCTTCACTG

CAAACGATGATGTGACCGAGGTTGACTGGCGCTCCTGGACGAAGTCGCCCATGGTCGACTTGATCAAGGGAC

GTCAGGCGGCCGGGTATGCTGGCGGCATCGCAGCGCTCGACCGGTACCTGAACCCGTCCCTTGGCACCGTCG

ATGTCACCATCAAGTCGGCCGACAACCTCGATGGCGATTTCCTGTCCAGCTCCTACGCCACTCTCATGGTCACG

GACGCCGACCCCGAGCAAGTGCATGCCAAGGAGTGGGGGACGAGTCCTGAGTTCGATGCCAAGCCCGTCCA

GTTCAGCCTGCTCAAGCCCGACTCCAAGCTCTACATGAACGTCATGCTGACCAAGTACGGCGTCGACACGCCC

GTCGGATACGCCGTCTTTGACATCCAGAAGAGCCTCAAGTCCGGCGAGACTGTGACCGAGACCTTTCAGCTCG

AGGGCAGCAACGATGCAACGTTGACGGTCGAGATGGAGCTCAACCTCCGGCAGGGCAGCGTCCTCCCTCAAT

CCAAGGCCCAGAAGAATCTGGCGACCCTTGTCGCCCTCCAGCAGTCTGTCGAGAGGGTCCGAGACCGCATCG

TTACTATCGGCAAGCTGGCCGGCGAGCCCGAGAAGTCGGTATGGGAGTACGAGCGAAAGTCCGGCCTTCCCA

AGTCCGTCAAGGGTCTTCCTCGATCGGAAGTGCTGCCGCCGCACAAGATCGCTCTCATGGTCGACGCCATCGC

CGAGTACGCTTACACTCAGTTCCAGCTCGTCCAGCGCCTGCTCCCCGTCAGAAACTCGTACGACCGGTACGCC

GCTTACTTTGCCCCAGAAGGCGAGGAGTACGTTCCCATCCCGCAGATCCTCAAGGACATGACGTGGTCCACCG

ACGACGAGTTCATCCGCCAGATCTTTGCCGGCCTCAACCCGTTGCAAGTCGAGGTCGTCAAGAACAAGGCCG

GTCTGCCCTCCAAGTTGCAGGAGCTCAAGGCCAAGGACGGATCTGATGTCGATAAGCTCATCTCGGAAGGCC

GGTTGTATGTTCTGGACTACTCGGTCCTCAAGGATCTCGACCTCAACCGCAACGGTGTCACCCTGTACGCGCC

GACGATGCTCATCTACCGCACTGGTGGTGACAAGCTCGACGTCCTCGGCATCATGCTCGAGCCCCGCCGTGAC

GATGCGCCCGTTTACACGCCCGACTCTGAAACTCCCAACAAGTTCCTTCTCGCCAAGTGCCACGTTGCCTGCGC

TGACAACCAAGTGCACCAGTTCACGTACCATCTCGGTTACGCCCATCTTGCCACGGAGCCACTTGCGATCGCA

AGCCACAACGTCCTGGAGAAGAACAGCCATCCGCTCGGCATGTTCCTCAAGCCACACTTGCGCGACAACATTG

GCATCAACTACCTCGCCCGGCAGACTCTTGTTGCCGACGAAGACGCCATCACAGACCACACCTTTGCCACGGG

CACCGCGCAGGGCGTCAGTATGGTCGTCGACGCCTTCAAGTCGTACAACTTCCTCGAGTCTGGCTTGCCCGAT

GAGCTGCGCCGTCGTGGATTCGAACGGTCGGACGACCTCAAGGTGTATCGCTACCGCGACGATGGCTGGTTG

GTCTGGGACACGCTCTGGAAGTACGCCGAGGATATGGTCAACGAGCTGTACGGAACGGACAACGATGTCGCT

GCTGACAAGGTCGTCCAGGAGTGGGCGAGGGAAGCATCTGGCTCGGACACTGCCGACGTCCAGGGCTTTCC

GGAGTCCATCACGACCAAGTACATCCTCACAAAGGTCCTGACGACGATCATCTGGCAAGCGTCCGCCTTGCAC

TCGGCTCTCAACTACATCCAATACCCGTACACTGCGACCCCCATCAACCGTGCCGCCTCCATCTTTGGACCGGT

CCCTGACGGCGAAGCGGATATCACCGAGCAGGACATCCTGGATGTCATCCCTGGTGGTCTGGACGATGAGAA

CAACCGTGGTCTGACCCTCTCCATCTTCCAAGGCCTGCTCTCGTGGCTCCTGCGCACTCCTGAGAACCCGACGC

-continued

TGGACGAAGTCGGCAGCCCAATCCCGAACAGGAACAACCCCATCGAGTGGGTCGAGTTCCGCTCGAAGTACC

CCCAGGTCTACTACAACTTGGACCAGAACCTTGCCGTGGTGGAGAAGATCATCGAGGAGCGCAACAAGGGCC

TTGCTTCTCCGTACGAGGTGCTCCTTCCCAGCCACATTGCTGCCAGCATCAACATCTGA

Codon-optimized coding sequence of CoLOX-19 by Genscript genetic codon frequency of *E. coli*

SEQ ID NO: 8

ATGACCAGCAGCCCGACCGTGCGTAGCATGGTTATGCTGGCGGTTCTGGCGGTTAGCGCGCTGGAAAGCGCG

CCGTGCGCGAGCGCGTTTGCGACCCTGCCGCGTGCGCTGGTTCGTCCGCAGGCGGCGCTGAAGTACCGTGCG

GAAGACAAAAACGATGTTGATGTTGCGCCGGCGGGTAGCACCGCGAGCGATGTTAGCAAGCCGGAGGGTAA

AGCGACCGCGGTTGCGAAGGGCACCGTGAACGCGCCGATCGAGGAAGCGTGGAAAGTGTTCCGTAGCTTTA

GCAACATGGACCAATGGATGCCGGTTTATGGCGAGTGGGAAGCGACCGGTGACAGCGTGGGCGATACCCGT

ACCTTCAACTTTAAGGATCAGCCGACCTTCTTTACCACCGAGCGTCTGGTGGGTCTGGACGATAGCCAATATAA

GATGAAATACACCCTGGTTGACTGCAAAGGCAGCCCGGTGCCGATCGAAAGCATTGATACCATCGTTACCTTC

ACCGCGAACGACGATGTGACCGAGGTTGACTGGCGTAGCTGGACCAAGAGCCCGATGGTGGATCTGATTAAA

GGTCGTCAAGCGGCGGGTTATGCGGGTGGCATTGCGGCGCTGGACCGTTATCTGAACCCGAGCCTGGGCACC

GTGGACGTTACCATTAAGAGCGCGGATAACCTGGACGGCGATTTTCTGAGCAGCAGCTACGCGACCCTGATG

GTTACCGATGCGGATCCGGAGCAGGTGCATGCGAAGGAATGGGGCACCAGCCCGGAGTTCGACGCGAAACC

GGTTCAATTTAGCCTGCTGAAGCCGGATAGCAAACTGTATATGAACGTGATGCTGACCAAATACGGTGTGGAC

ACCCCGGTTGGCTATGCGGTGTTCGATATCCAGAAGAGCCTGAAAAGCGGCGAGACCGTTACCGAAACCTTTC

AACTGGAAGGCAGCAACGACGCGACCCTGACCGTTGAGATGGAACTGAACCTGCGTCAGGGTAGCGTGCTG

CCGCAGAGCAAGGCGCAGAAGAACCTGGCGACCCTGGTGGCGCTGCAGCAAAGCGTGGAGCGTGTTCGTGA

CCGTATTGTTACCATCGGTAAACTGGCGGGTGAACCGGAGAAGAGCGTGTGGGAGTACGAGCGTAAGAGCG

GTCTGCCGAAGAGCGTTAAAGGTCTGCCGCGTAGCGAAGTGCTGCCGCCGCACAAAATTGCGCTGATGGTTG

ACGCGATCGCGGAGTACGCGTATACCCAGTTCCAACTGGTTCAGCGTCTGCTGCCGGTGCGTAACAGCTACGA

CCGTTATGCGGCGTACTTTGCGCCGGAAGGCGAGGAATACGTGCCGATTCCGCAAATCCTGAAGGATATGAC

CTGGAGCACCGACGATGAGTTCATTCGTCAGATCTTTGCGGGTCTGAACCCGCTGCAAGTTGAAGTGGTTAAG

AACAAAGCGGGTCTGCCGAGCAAGCTGCAGGAGCTGAAGGCGAAAGACGGTAGCGACGTGGATAAACTGAT

CAGCGAGGGCCGTCTGTATGTTCTGGATTACAGCGTGCTGAAGGACCTGGATCTGAACCGTAACGGTGTTACC

CTGTATGCGCCGACCATGCTGATTTACCGTACCGGTGGCGACAAACTGGATGTTCTGGGCATCATGCTGGAAC

CGCGTCGTGACGATGCGCCGGTGTACACCCCGGACAGCGAGACCCCGAACAAGTTCCTGCTGGCGAAATGCC

ACGTTGCGTGCGCGGATAACCAGGTGCACCAATTTACCTATCACCTGGGTTATGCGCACCTGGCGACCGAACC

GCTGGCGATTGCGAGCCACAACGTGCTGGAGAAGAACAGCCACCCGCTGGGCATGTTCCTGAAACCGCACCT

GCGTGACAACATCGGCATTAACTACCTGGCGCGTCAGACCCTGGTTGCGGACGAAGATGCGATCACCGATCA

CACCTTTGCGACCGGCACCGCGCAAGGCGTGAGCATGGTGGTTGACGCGTTCAAGAGCTATAACTTTCTGGA

AAGCGGTCTGCCGGATGAGCTGCGTCGTCGTGGTTTCGAGCGTAGCGACGATCTGAAGGTTTACCGTTATCGT

GACGATGGTTGGCTGGTGTGGGACACCCTGTGGAAATACGCGGAGGATATGGTTAACGAACTGTATGGCACC

GACAACGATGTGGCGGCGGACAAAGTGGTTCAGGAGTGGGCGCGTGAAGCGAGCGGTAGCGACACCGCGG

ATGTTCAAGGCTTCCCGGAAAGCATTACCACCAAGTACATCCTGACCAAAGTGCTGACCACCATCATTTGGCA

AGCGAGCGCGCTGCACAGCGCGCTGAACTATATTCAATACCCGTATACCGCGACCCCGATTAACCGTGCGGCG

AGCATCTTTGGTCCGGTTCCGGACGGCGAGGCGGATATTACCGAACAGGACATTCTGGATGTGATCCCGGGT

GGCCTGGACGATGAGAACAACCGTGGTCTGACCCTGAGCATCTTCCAAGGTCTGCTGAGCTGGCTGCTGCGT

ACCCCGGAAAACCCGACCCTGGACGAGGTTGGTAGCCCGATTCCGAACCGTAACAACCCGATCGAGTGGGTT

-continued

GAATTTCGTAGCAAATACCCGCAGGTGTACTATAACCTGGATCAAAACCTGGCGGTGGTTGAAAAGATCATTG

AGGAACGTAACAAAGGCCTGGCGAGCCCGTATGAGGTGCTGCTGCCGAGCCACATTGCGGCGAGCATCAAC

AAA

Amino acid Sequence for CoLOX-19

SEQ ID NO: 9

MTSSPTVRSMVMLAVLAVSALESAPCASAFATLPRALVRPQAALKYRAEDKNDVDVAPAGSTASDVSKPEGKATA

VAKGTVNAPIEEAWKVFRSFSNMDQWMPVYGEWEATGDSVGDTRTFNFKDQPTFFTTERLVGLDDSQYKMKYT

LVDCKGSPVPIESIDTIVTFTANDDVTEVDWRSWTKSPMVDLIKGRQAAGYAGGIAALDRYLNPSLGTVDVTIKSAD

NLDGDFLSSSYATLMVTDADPEQVHAKEWGTSPEFDAKPVQFSLLKPDSKLYMNVMLTKYGVDTPVGYAVFDIQ

KSLKSGETVTETFQLEGSNDATLTVEMELNLRQGSVLPQSKAQKNLATLVALQQSVERVRDRIVTIGKLAGEPEKSV

WEYERKSGLPKSVKGLPRSEVLPPHKIALMVDAIAEYAYTQFQLVQRLLPVRNSYDRYAAYFAPEGEEYVPIPQILKD

MTWSTDDEFIRQIFAGLNPLQVEVVKNKAGLPSKLQELKAKDGSDVDKLISEGRLYVLDYSVLKDLDLNRNGVTLYA

PTMLIYRTGGDKLDVLGIMLEPRRDDAPVYTPDSETPNKFLLAKCHVACADNQVHQFTYHLGYAHLATEPLAIASH

NVLEKNSHPLGMFLKPHLRDNIGINYLARQTLVADEDAITDHTFATGTAQGVSMVVDAFKSYNFLESGLPDELRRR

GFERSDDLKVYRYRDDGWLVWDTLWKYAEDMVNELYGTDNDVAADKVVQEWAREASGSDTADVQGFPESITT

KYILTKVLTTIIWQASALHSALNYIQYPYTATPINRAASIFGPVPDGEADITEQDILDVIPGGLDDENNRGLTLSIFQGLL

SWLLRTPENPTLDEVGSPIPNRNNPIEWVEFRSKYPQVYYNLDQNLAVVEKIIEERNKGLASPYEVLLPSHIAASINI

Coding sequence for CoLOX-22

SEQ ID NO: 10

ATGACGTCGTCTCCGACCGTCAGATCGATGGTAATGCTGGCCGTGCTGGCCGTCTCTGCCCTGGAGAGCGCGC

CCTGCGCCTCGGCCTTTGCCACGCTCCCCCGCGCCCTCGTACGACCGCAAGCCGCCCTCAAGTACCGAGCCGA

GGACAAAAACGACGTCGATGTCGCCCCGGCTGGTAGCACTGCCTCCGACGTGAGCAAGCCCGAAGGCAAGG

CCACCGCCGTCGCCAAGGGTACTGTCAACGCGCCCATCGAGGAGGCATGGAAGGTCTTCCGGTCTTTTTCCAA

CATGAACCAATGGATGCCCGTGTACGGCGAGTGGGAGGCCACGGGAGACTCAGTCGGAGACACCCGCACGT

TCAACTTCAAGGATCAGCCGACCTTCTTCACTACCGAGAGGCTTGTCGGCCTGGACGACTCCCAGTACAAGAT

GAAGTACACCCTCGTCGACTGCAAGGGCTCGCCCGTGCCCATCGAATCTATCGACACCATCGTCACCTTCACTG

CAAACGATGATGTGACCGAGGTTGACTGGCGCTCCTGGACGAAGTCGCCCATGGTCGACTTGATCAAGGGAC

GTCAGGCGGCCGGGTATGCCGGCGGCATCGCAGCGCTCGACCGGTACCTGAACCCGTCCCTTGGCACCGTCG

ATGTCACCATCAAGTCGGCCGACAACCTCGATGGTGATTTCCTGTCCAGCTCCTACGCCACTCTCATGGTCACG

GACGCCGACCCCGAGCAAGTGCATGCCAAGGAGTGGGGGACGAGTCCTGAGTTTGATGCCAAGCCCGTCCA

GTTCAGCCTGCTCAAGCCCGACTCCAAGCTCTACATGAGCGTCATGCTGACCAAGTGCGGCGTCGACGCCCCC

GTCGGATACGCCGTCTTTGACATCCAGAAGAGCCTCAAGTCCGGCGAGACTGTGACCGAGACCTTTCAGCTCG

AGGGCAGCAACGATGCAACGTTGACGGTCGAGATGGAGCTCAACCTCCGGCAGGGCAGCATCCTCCCTCAAT

CCAAGGCCCAGAAGAATCTGGCGACCCTTGTCGCCCTCCAGCAGTCTGTCGAGAGGGTCCGAGACCGCATCG

TTACTATCGGCAAGCTGGCCGGCGAGCCCGAGAAGTCGGTATGGGAGTACGAGCGAAAGTCCGGCCTTCCCA

AGTCCGTCAAGGGCCTTCCTCGGTCGGAAGTGCTGCCGCCGCACAAGATCGCCCTCATGGTCGACGCCATCGC

CGAGTACGCTTACACCCAGTTCCAGCTCGTCCAGCGCCTGCTCCCCGTCAGAAACTCGTACGACCGGTACGCC

GCTTACTTTGCCCCAGAAGGCGAGGAGTACGTTCCCATCCCGCAGATCCTCAAGGACATGACGTGGTCCACCG

ACGACGAGTTCATCCGCCAGATCTTTGCCGGCCTCAACCCGTTGCAAGTCGAGGTCGTCAAGAACAAGGCCG

GTCTGCCCTCCAAGTTGCAGGAGCTCAAGGCCAAGGACGGATCTGATGTCGATAAGCTCATCTCGGAAGGCC

GGTTGTATGTTCTGGACTACTCGGTCCTCAAGGATCTCGACCTCAACCGCAACGGTGTCACCCTGTACGCGCC

GACGATGCTCATCTACCGCACTGGTGGTGACAAGCTCGACGTCCTCGGCATCATGCTCGAGCCCCGCCGTGAC

-continued

GATGCGCCCGTTTACACGCCCGACTCTGAAACTCCCAACAAGTTCCTTCTCGCCAAGTGCCACGTTGCCTGCGC

TGACAACCAAGTGCACCAGTTCACGTACCATCTCGGTTACGCCCATCTTGCCACGGAGCCACTTGCGATCGCA

AGCCACAACGTCCTGGAGAAGAACAGCCATCCGCTCGGCATGTTCCTCAAGCCACACTTGCGCGACAACATTG

GCATCAACTACCTCGCCCGGCAGACTCTTGTTGCCGACGAAGACGCCATCACAGACCACACCTTTGCCACGGG

CACCGCGCAGGGCGTCAGTATGGTCGTCGACGCCTTCAAGTCGTACAACTTCCTCGAGTCTGGCTTGCCCGAT

GAGCTGCGCCGTCGTGGATTCGAACGGTCGGACGACCTCAAGGTGTATCGCTACCGCGACGATGGCTGGTTG

GTCTGGGACACGCTCTGGAAGTACGCCGAGGATATGGTCAACGAGCTGTACGGAACGGACAACGATGTCGCT

GCTGACAAGGTCGTCCAGGAGTGGGCGAGGGAAGCATCTGGCTCGGACACTGCCGACGTCCAGGGCTTTCC

GGAGTCCATCACGACCAAGTACATCCTCACAAAGGTCCTGACGACGATCATCTGGCAAGCGTCCGCCTTGCAC

TCGGCTCTCAACTACATCCAATACCCGTACACTGCGACCCCCATCAACCGTGCCGCCTCCATCTTTGGACCGGT

CCCTGACGGCGAAGCGGATATCACCGAGCAGGACATCCTGGATGTCATCCCTGGTGGTCTGGGTGATGAGAA

CAACCGTGGTCTGACCCTCTCCATCTTCCAAGGCCTGCTCTCGTGGCTCCTGCGCACTCCTGAGAACCCGACGC

TGGACGAAGTCGGCAGTCCAATCCCGAACAGGAACAACCCCATCGAGTGGGTCGAGTTCCGCTCGAAGTATC

CCCAGGTCTACTACAACTTGGACCAGAACCTTGCCGTGGTGGAGAAGATCATCGAGGAGCGCAACAAGGGCC

TTGCTTCTCCGTACGAGGTGCTCCTTCCCAGCCACATCGCTGCCAGCATCAACATCTGA

Codon-optimized coding sequence of CoLOX-22 by Genscript genetic codon frequency of *E. coli*
SEQ ID NO: 11

ATGACCAGCAGCCCGACCGTGCGTAGCATGGTTATGCTGGCGGTTCTGGCGGTTAGCGCGCTGGAAAGCGCG

CCGTGCGCGAGCGCGTTTGCGACCCTGCCGCGTGCGCTGGTTCGTCCGCAGGCGGCGCTGAAGTATCGTGCG

GAAGACAAAAACGATGTTGATGTTGCGCCGGCGGGTAGCACCGCGAGCGATGTTAGCAAGCCGGAGGGTAA

AGCGACCGCGGTTGCGAAGGGCACCGTGAACGCGCCGATCGAGGAAGCGTGGAAAGTGTTCCGTAGCTTTA

GCAACATGAACCAATGGATGCCGGTTTACGGCGAGTGGGAAGCGACCGGTGACAGCGTGGGCGATACCCGT

ACCTTCAACTTTAAGGACCAGCCGACCTTCTTTACCACCGAGCGTCTGGTGGGTCTGGACGATAGCCAATATA

AGATGAAATACACCCTGGTTGACTGCAAAGGCAGCCCGGTGCCGATCGAAAGCATTGATACCATCGTTACCTT

CACCGCGAACGACGATGTGACCGAGGTTGACTGGCGTAGCTGGACCAAGAGCCCGATGGTGGATCTGATTAA

AGGTCGTCAAGCGGCGGGTTATGCGGGTGGCATTGCGGCGCTGGACCGTTACCTGAACCCGAGCCTGGGCAC

CGTGGACGTTACCATCAAGAGCGCGGATAACCTGGACGGCGATTTTCTGAGCAGCAGCTACGCGACCCTGAT

GGTTACCGATGCGGATCCGGAGCAGGTGCATGCGAAGGAATGGGGCACCAGCCCGGAGTTCGACGCGAAAC

CGGTTCAATTTAGCCTGCTGAAGCCGGATAGCAAACTGTATATGAGCGTGATGCTGACCAAATGCGGTGTGG

ATGCGCCGGTTGGTTATGCGGTGTTCGATATTCAGAAGAGCCTGAAAAGCGGCGAGACCGTTACCGAAACCT

TTCAACTGGAAGGCAGCAACGACGCGACCCTGACCGTGGAGATGGAACTGAACCTGCGTCAGGGTAGCATCC

TGCCGCAGAGCAAGGCGCAGAAGAACCTGGCGACCCTGGTTGCGCTGCAGCAAAGCGTGGAGCGTGTTCGT

GATCGTATTGTTACCATCGGTAAACTGGCGGGTGAACCGGAGAAGAGCGTGTGGGAGTATGAGCGTAAGAG

CGGTCTGCCGAAGAGCGTTAAAGGTCTGCCGCGTAGCGAAGTGCTGCCGCCGCACAAAATTGCGCTGATGGT

TGACGCGATCGCGGAGTACGCGTATACCCAGTTCCAACTGGTTCAGCGTCTGCTGCCGGTGCGTAACAGCTAC

GACCGTTATGCGGCGTACTTTGCGCCGGAAGGCGAGGAATACGTGCCGATTCCGCAAATCCTGAAGGATATG

ACCTGGAGCACCGACGATGAGTTCATTCGTCAGATCTTTGCGGGTCTGAACCCGCTGCAAGTTGAAGTGGTTA

AGAACAAAGCGGGTCTGCCGAGCAAGCTGCAGGAGCTGAAGGCGAAAGACGGTAGCGACGTGGATAAACT

GATCAGCGAGGGCCGTCTGTATGTTCTGGATTACAGCGTGCTGAAGGACCTGGATCTGAACCGTAACGGTGT

TACCCTGTATGCGCCGACCATGCTGATTTACCGTACCGGTGGCGACAAACTGGATGTTCTGGGCATCATGCTG

GAACCGCGTCGTGACGATGCGCCGGTGTACACCCCGGACAGCGAGACCCCGAACAAGTTCCTGCTGGCGAAA

TGCCACGTTGCGTGCGCGGATAACCAGGTGCACCAATTTACCTATCACCTGGGTTATGCGCACCTGGCGACCG

-continued

AACCGCTGGCGATTGCGAGCCACAACGTGCTGGAGAAGAACAGCCACCCGCTGGGCATGTTCCTGAAACCGC

ACCTGCGTGACAACATCGGCATTAACTATCTGGCGCGTCAGACCCTGGTTGCGGACGAAGATGCGATCACCG

ATCACACCTTTGCGACCGGCACCGCGCAAGGCGTGAGCATGGTGGTTGACGCGTTCAAGAGCTACAACTTTCT

GGAAAGCGGTCTGCCGGATGAGCTGCGTCGTCGTGGTTTCGAGCGTAGCGACGATCTGAAGGTTTACCGTTA

TCGTGACGATGGTTGGCTGGTGTGGGACACCCTGTGGAAATATGCGGAGGATATGGTTAACGAACTGTACGG

CACCGACAACGATGTGGCGGCGGACAAAGTGGTTCAGGAGTGGGCGCGTGAAGCGAGCGGTAGCGACACC

GCGGATGTTCAAGGCTTCCCGGAAAGCATTACCACCAAGTATATCCTGACCAAAGTGCTGACCACCATCATTT

GGCAAGCGAGCGCGCTGCACAGCGCGCTGAACTACATTCAATACCCGTATACCGCGACCCCGATTAACCGTGC

GGCGAGCATCTTTGGTCCGGTTCCGGACGGCGAGGCGGATATTACCGAACAGGACATTCTGGATGTGATCCC

GGGTGGCCTGGGTGACGAGAACAACCGTGGCCTGACCCTGAGCATCTTCCAAGGTCTGCTGAGCTGGCTGCT

GCGTACCCCGGAAAACCCGACCCTGGATGAGGTTGGCAGCCCGATTCCGAACCGTAACAACCCGATCGAGTG

GGTTGAATTTCGTAGCAAATATCCGCAGGTGTACTATAACCTGGACCAAAACCTGGCGGTGGTTGAAAAGATC

ATTGAGGAACGTAACAAAGGTCTGGCGAGCCCGTACGAGGTGCTGCTGCCGAGCCACATTGCGGCGAGCATC

AACATTTAA

Amino acid Sequence for CoLOX-22

SEQ ID NO: 12

MTSSPTVRSMVMLAVLAVSALESAPCASAFATLPRALVRPQAALKYRAEDKNDVDVAPAGSTASDVSKPEGKATA

VAKGTVNAPIEEAWKVFRSFSNMNQWMPVYGEWEATGDSVGDTRTFNFKDQPTFFTTERLVGLDDSQYKMKY

TLVDCKGSPVPIESIDTIVTFTANDDVTEVDWRSWTKSPMVDLIKGRQAAGYAGGIAALDRYLNPSLGTVDVTIKSA

DNLDGDFLSSSYATLMVTDADPEQVHAKEWGTSPEFDAKPVQFSLLKPDSKLYMSVMLTKCGVDAPVGYAVFDI

QKSLKSGETVTETFQLEGSNDATLTVEMELNLRQGSILPQSKAQKNLATLVALQQSVERVRDRIVTIGKLAGEPEKSV

WEYERKSGLPKSVKGLPRSEVLPPHKIALMVDAIAEYAYTQFQLVQRLLPVRNSYDRYAAYFAPEGEEYVPIPQILKD

MTWSTDDEFIRQIFAGLNPLQVEVVKNKAGLPSKLQELKAKDGSDVDKLISEGRLYVLDYSVLKDLDLNRNGVTLYA

PTMLIYRTGGDKLDVLGIMLEPRRDDAPVYTPDSETPNKFLLAKCHVACADNQVHQFTYHLGYAHLATEPLAIASH

NVLEKNSHPLGMFLKPHLRDNIGINYLARQTLVADEDAITDHTFATGTAQGVSMVVDAFKSYNFLESGLPDELRRR

GFERSDDLKVYRYRDDGWLVWDTLWKYAEDMVNELYGTDNDVAADKVVQEWAREASGSDTADVQGFPESITT

KYILTKVLTTIIWQASALHSALNYIQYPYTATPINRAASIFGPVPDGEADITEQDILDVIPGGLGDENNRGLTLSIFQGL

LSWLLRTPENPTLDEVGSPIPNRNNPIEWVEFRSKYPQVYYNLDQNLAVVEKIIEERNKGLASPYEVLLPSHIAASINI

Coding sequence for CoLOX-d4

SEQ ID NO: 13

ATGACGTCGTCTCCGACCGTCAGATCGATGGTAATGCTGGCCGTGCTGGCCGTCTCTGCCCTGGAGAGCGCGC

CCTGCGCCTCGGCCTTTGCCACGCTCCCCCGCGCCCTCGTACGACCGCAAGCCGCCCTCAAGTACCGAGCCGA

GGACAAAAACGACGTCGATGTCGCCCCGGCTGGTAGCACTGCCTCCGACGTGAGCAAGCCCGAAGGAAAGG

CCACTGCTGTCGCCAAGGGTACTGTCAACGCGCCCATCGAGGAGGCATGGAAGGTCTTCCGGTCTTTTTCCAA

CATGGACCAATGGATGCCCGTGTACGGCGAGTGGGAGGCCACGGGAGACTCAGTCGGAGACACCCGCACGT

TCAACTTCAAGGATCAGCCGACCTTCTTCACTACCGAGAGGCTTGTCGGCCTGGACGACTCCCAGTACAAGAT

GAAGTACACCCTCGTCGACTGCAAGGGCTCGCCCGTGCCCATCGAATCTATTGACACCATCGTCACCTTCACTG

CAAACGATGATGTGACCGAGGTTGACTGGCGCTCCTGGACGAAGTCGCCCATGGTCGACTTGATCAAGGGAC

GTCAGGCGGCCGGGTATGCTGGCGGCATCGCAGCGCTCGACCGGTACCTGAACCCGTCCCTTGGCACCGTCG

ATGTCACCATCAAGTCGGCCGACAACCTCGATGGCGATTTCCTGTCCAGCTCCTACGCCACTCTCATGGTCACG

GACGCCGACCCCGAGCAAGTGCATGCCAAGGAGTGGGGGACGAGTCCTGAGTTCGATGCCAAGCCCGTCCA

GTTCAGCCTGCTCAAGCCCGACTCCAAGCTCTACATGAACGTCATGCTGACCAAGTACGGCGTCGACACGCCC

-continued

GTCGGATACGCCGTCTTTGACATCCAGAAGAGCCTCAAGTCCGGCGAGACTGTGACCGAGACCTTTCAGCTCG

AGGGCAGCAACGATGCAACGTTGACGGTCGAGATGGAGCTCAACCTCCGGCAGGGCAGCGTCCTCCCTCAAT

CCAAGGCCCAGAAGAATCTGGCGACCCTTGTCGCCCTCCAGCAGTCTGTCGAGAGGGTCCGAGACCGCATCG

TTACTATCGGCAAGCTGGCCGGCGAGCCCGAGAAGTCGGTATGGGAGTACGAGCGAAAGTCCGGCCTTCCCA

AGTCCGTCAAGGGTCTTCCTCGATCGGAAGTGCTGCCGCCGCACAAGATCGCTCTCATGGTCGACGCCATCGC

CGAGTACGCTTACACTCAGTTCCAGCTCGTCCAGCGCCTGCTCCCCGTCAGAAACTCGTACGACCGGTACGCC

GCTTACTTTGCCCCAGAAGGCGAGGAGTACGTTCCCATCCCGCAGATCCTCAAGGACATGACGTGGTCCACCG

ACGACGAGTTCATCCGCCAGATCTTTGCCGGCCTCAACCCGTTGCAAGTCGAGGTCGTCAAGAACAAGGCCG

GTCTGCCCTCCAAGTTGCAGGAGCTCAAGGCCAAGGACGGATCTGATGTCGATAAGCTCATCTCGGAAGGCC

GGTTGTATGTTCTGGACTACTCGGTCCTCAAGGATCTCGACCTCAACCGCAACGGTGTCACCCTGTACGCGCC

GACGATGCTCATCTACCGCACTGGTGGTGACAAGCTCGACGTCCTCGGCATCATGCTCGAGCCCCGCCGTGAC

GATGCGCCCGTTTACACGCCCGACTCTGAAACTCCCAACAAGTTCCTTCTTGCCAAGTGCCACGTTGCCTGCGC

TGACAACCAAGTGCACCAGTTCACGTACCATCTCGGTTACGCCCATCTTGCCACGGAGCCACTTGCGATCGCA

AGCCACAACGTCCTGGAGAAGAACAGCCATCCGCTCGGCATGTTCCTCAAGCCACACTTCCGCGACAACATCG

GCATCAACTACCTCGCCCGGCAGACTCTTGTTGCCGACGAAGACGCCATCACAGACCACACTTTTGCCACGGG

CACCGCGCAGGGCGTCAGTATGGTCGTCGACGCCTTCAAGTCGTACAACTTCCTCGAGTCTGGCTTGCCCGAT

GAGCTGCGCCGTCGTGGATTCGAACGGTCGGACGACCTCAAGGTGTATCGCTACCGCGACGATGGCTGGTTG

GTTTGGGACACGCTCTGGAAGTACGCCGAGGATATGGTCAACGAGCTGTACGGAACGGACAACGATGTCACT

GCTGACAAGGTCGTCCAGGAGTGGGCGAGGGAAGCATCTGGCTCGGACACTGCCGACGTCCAGGGCTTTCC

GGAGTCCATCACGACCAAGTACATCCTCACAAAGGTCCTGACGACGATCATCTGGCAAGCGTCCGCCTTGCAC

TCGGCTCTCAACTACATCCAATACCCGTACACTGCGACCCCCATCAACCGTGCCGCCTCCATCTTTGGACCGGT

CCCTGACGGCGAAGCGGATATCACCGAGCAGGACATCCTGGATGTCATCCCTGGTGGTCTGGACGATGAGAA

CAACCGTGGTCTGACCCTCTCCATCTTCCAAGGCCTGCTCTCGTGGCTCCTGCGCACTCCTGAGAACCCGACGC

TGGACGAAGTCGGCAGCCCAATCCCGAACAGGAACAACCCCATCGAGTGGGTCGAGTTCCGCTCGAAGTACC

CCCAGGTCTACTACAACTTGGACCAGAACCTTGCCGTGGTGGAGAAGATCATCGAGGAGCGCAACAAGGGCC

TTGCTTCTCCGTACGAGGTGCTCCTTCCCAGCCACATTGCTGCCAGCATCAACATCTGA

Codon-optimized coding sequence of CoLOX-d4 by Genscript genetic codon frequency of *E. coli*

SEQ ID NO: 14

ATGACCAGCAGCCCGACCGTGCGTAGCATGGTTATGCTGGCGGTTCTGGCGGTTAGCGCGCTGGAAAGCGCG

CCGTGCGCGAGCGCGTTTGCGACCCTGCCGCGTGCGCTGGTTCGTCCGCAGGCGGCGCTGAAGTACCGTGCG

GAAGACAAAAACGATGTTGATGTTGCGCCGGCGGGTAGCACCGCGAGCGATGTTAGCAAGCCGGAGGGTAA

AGCGACCGCGGTTGCGAAGGGCACCGTGAACGCGCCGATCGAGGAAGCGTGGAAAGTGTTCCGTAGCTTTA

GCAACATGGACCAATGGATGCCGGTTTATGGCGAGTGGGAAGCGACCGGTGACAGCGTGGGCGATACCCGT

ACCTTCAACTTTAAGGATCAGCCGACCTTCTTTACCACCGAGCGTCTGGTGGGTCTGGACGATAGCCAATATAA

GATGAAATACACCCTGGTTGACTGCAAAGGCAGCCCGGTGCCGATCGAAAGCATTGATACCATCGTTACCTTC

ACCGCGAACGACGATGTGACCGAGGTTGACTGGCGTAGCTGGACCAAGAGCCCGATGGTGGATCTGATTAAA

GGTCGTCAAGCGGCGGGTTATGCGGGTGGCATTGCGGCGCTGGACCGTTATCTGAACCCGAGCCTGGGCACC

GTGGACGTTACCATTAAGAGCGCGGATAACCTGGACGGCGATTTCCTGAGCAGCAGCTACGCGACCCTGATG

GTTACCGATGCGGATCCGGAGCAGGTGCATGCGAAGGAATGGGGCACCAGCCCGGAGTTCGACGCGAAACC

GGTTCAATTTAGCCTGCTGAAGCCGGATAGCAAACTGTATATGAACGTGATGCTGACCAAATACGGTGTGGAC

ACCCCGGTTGGCTATGCGGTGTTCGATATCCAGAAGAGCCTGAAAAGCGGCGAGACCGTTACCGAAACCTTTC

AACTGGAAGGCAGCAACGACGCGACCCTGACCGTTGAGATGGAACTGAACCTGCGTCAGGGTAGCGTGCTG

-continued

CCGCAGAGCAAGGCGCAGAAGAACCTGGCGACCCTGGTGGCGCTGCAGCAAAGCGTGGAGCGTGTTCGTGA

CCGTATTGTTACCATCGGTAAACTGGCGGGTGAACCGGAGAAGAGCGTGTGGGAGTACGAGCGTAAGAGCG

GTCTGCCGAAGAGCGTTAAAGGTCTGCCGCGTAGCGAAGTGCTGCCGCCGCACAAAATTGCGCTGATGGTTG

ACGCGATCGCGGAGTACGCGTATACCCAGTTCCAACTGGTTCAGCGTCTGCTGCCGGTGCGTAACAGCTACGA

CCGTTATGCGGCGTACTTTGCGCCGGAAGGCGAGGAATACGTGCCGATTCCGCAAATCCTGAAGGATATGAC

CTGGAGCACCGACGATGAGTTCATTCGTCAGATCTTTGCGGGTCTGAACCCGCTGCAAGTTGAAGTGGTTAAG

AACAAAGCGGGTCTGCCGAGCAAGCTGCAGGAGCTGAAGGCGAAAGACGGTAGCGACGTGGATAAACTGAT

CAGCGAGGGCCGTCTGTATGTTCTGGATTACAGCGTGCTGAAGGACCTGGATCTGAACCGTAACGGTGTTACC

CTGTATGCGCCGACCATGCTGATTTACCGTACCGGTGGCGACAAACTGGATGTTCTGGGCATCATGCTGGAAC

CGCGTCGTGACGATGCGCCGGTGTACACCCCGGACAGCGAGACCCCGAACAAGTTCCTGCTGGCGAAATGCC

ACGTTGCGTGCGCGGATAACCAGGTGCACCAATTTACCTATCACCTGGGTTATGCGCACCTGGCGACCGAACC

GCTGGCGATTGCGAGCCACAACGTGCTGGAGAAGAACAGCCACCCGCTGGGCATGTTCCTGAAACCGCACTT

TCGTGACAACATCGGCATTAACTACCTGGCGCGTCAGACCCTGGTTGCGGACGAAGATGCGATCACCGATCAT

ACCTTTGCGACCGGCACCGCGCAAGGCGTGAGCATGGTGGTTGACGCGTTCAAGAGCTATAACTTTCTGGAA

AGCGGTCTGCCGGATGAGCTGCGTCGTCGTGGTTTCGAGCGTAGCGACGATCTGAAGGTTTACCGTTATCGT

GACGATGGTTGGCTGGTGTGGGACACCCTGTGGAAATACGCGGAGGATATGGTTAACGAACTGTATGGCACC

GACAACGATGTGACCGCGGACAAAGTGGTTCAGGAGTGGGCGCGTGAAGCGAGCGGTAGCGACACCGCGG

ATGTTCAAGGCTTCCCGGAAAGCATTACCACCAAGTACATCCTGACCAAAGTGCTGACCACCATCATTTGGCA

AGCGAGCGCGCTGCACAGCGCGCTGAACTATATTCAATACCCGTATACCGCGACCCCGATTAACCGTGCGGCG

AGCATCTTTGGTCCGGTTCCGGACGGCGAGGCGGATATTACCGAACAGGACATTCTGGATGTGATCCCGGGT

GGCCTGGACGATGAGAACAACCGTGGTCTGACCCTGAGCATCTTCCAAGGTCTGCTGAGCTGGCTGCTGCGT

ACCCCGGAAAACCCGACCCTGGACGAGGTTGGTAGCCCGATTCCGAACCGTAACAACCCGATCGAGTGGGTT

GAATTTCGTAGCAAATACCCGCAGGTGTACTATAACCTGGATCAAAACCTGGCGGTGGTTGAAAAGATCATTG

AGGAACGTAACAAAGGCCTGGCGAGCCCGTATGAGGTGCTGCTGCCGAGCCACATTGCGGCGAGCATCAAC

ATTTAA

Amino acid Sequence for CoLOX-d4

SEQ ID NO: 15

MTSSPTVRSMVMLAVLAVSALESAPCASAFATLPRALVRPQAALKYRAEDKNDVDVAPAGSTASDVSKPEGKATA

VAKGTVNAPIEEAWKVFRSFSNMDQWMPVYGEWEATGDSVGDTRTFNFKDQPTFFTTERLVGLDDSQYKMKYT

LVDCKGSPVPIESIDTIVTFTANDDVTEVDWRSWTKSPMVDLIKGRQAAGYAGGIAALDRYLNPSLGTVDVTIKSAD

NLDGDFLSSSYATLMVTDADPEQVHAKEWGTSPEFDAKPVQFSLLKPDSKLYMNVMLTKYGVDTPVGYAVFDIQ

KSLKSGETVTETFQLEGSNDATLTVEMELNLRQGSVLPQSKAQKNLATLVALQQSVERVRDRIVTIGKLAGEPEKSV

WEYERKSGLPKSVKGLPRSEVLPPHKIALMVDAIAEYAYTQFQLVQRLLPVRNSYDRYAAYFAPEGEEYVPIPQILKD

MTWSTDDEFIRQIFAGLNPLQVEVVKNKAGLPSKLQELKAKDGSDVDKLISEGRLYVLDYSVLKDLDLNRNGVTLYA

PTMLIYRTGGDKLDVLGIMLEPRRDDAPVYTPDSETPNKFLLAKCHVACADNQVHQFTYHLGYAHLATEPLAIASH

NVLEKNSHPLGMFLKPHFRDNIGINYLARQTLVADEDAITDHTFATGTAQGVSMVVDAFKSYNFLESGLPDELRRR

GFERSDDLKVYRYRDDGWLVWDTLWKYAEDMVNELYGTDNDVTADKVVQEWAREASGSDTADVQGFPESITT

KYILTKVLTTIIWQASALHSALNYIQYPYTATPINRAASIFGPVPDGEADITEQDILDVIPGGLDDENNRGLTLSIFQGLL

SWLLRTPENPTLDEVGSPIPNRNNPIEWVEFRSKYPQVYYNLDQNLAVVEKIIEERNKGLASPYEVLLPSHIAASINI

-continued

2. UfLOX
Coding sequence for UfLOX2

SEQ ID NO: 16

ATGCCTTCCATCAAACCATGCCTACCGGGTGACTCTGCCAACAGCGCAGCCCGGACAGCCTCAATCAAGGAGA

AGCGGGCGCAGATTGGATACGACTACAAGATGCTCCCTAAGCTCGCCCTGGCCTCAGCACCCCCAGCAAAGTT

CGTGGAGCTCTCTGATGCCTACATGGCTGAGCGCATTGGTGAAACTGCAAAGTTTTTTAAGAACAAGGAGATG

ACGAAGGCCCGGAGGATGTTTGACGTTGTCAACAGGATGGAGGACTTCAACGACTATTTCATTCTCCCTCCTG

TGATCGCGCCGGAGCATGCTAAGGGCAAGTGGATGGAGGATGACTTTTTTGCGGAGCAGCGCCTGTCCGGG

GCAAACCCTCTGGTCCTGGCTAAGCTCGACCGTGACGACGCCCGCGCAGAAATCCTCGAGGATATGAACCTTG

ACTTCAGCGTCAACAGCGAGCTCAGCAGAGGCAACATCTACGTCTGCGACTACACTGGGACGGACCCGACGT

ACCGCGGCCCTTGCATGGTCACGGGAGGCGAAAACAACTCTGGAAAGAAGAAGTGGCTGCCAAAACCCCTAT

CATGGTTCCGCTGGATTGAGGACGACAAAAACAAGGTGGGCGGCAAGCTCGTGCCTGTCGCCATTCAGCTCG

ATGCCAGTGAGGACCCAGTCAACTACGTCCGCAAGGACTCGCGGGTGTACACCCCCAACGAGGAGCACGAGT

ACGACTGGCTGTTTGCAAAGATCTGTGTCCAGGTGGCAGACTCTCTGCACCACGAGATGGGCTCCCATCTCGC

TCGCTGCCACTTCACGATGGAACCGATCGCCGTGTGTGTTCACCGGACGATGGCAGAAGAGCACCCCATCGCT

CTGCTCCTGAACCTGCACATGCGGTTCCACATTGCCAACGACTCGGTCGCGGCTTACACACTCATTGGTCCTTC

TGGCAACGTTGATGACTTGATGCCTGGAACCCTGCGCGAGTCCATGGCGCTACTGACGGAGTCATACGACAA

GTGGGACCTCATCGGCACCAACTTTGAGAACGACCTCTTCAACCGCGAGGTGAACGATGATGAACGCCTGCCC

CACTACCCCTACCGTGACGATGGCAAGCTCATCTGGAAGATCATCGAGGACTGGGTGGAGAAATACGTAAAT

GCCTTCTACGACAACGATGATGAGGTTGAGGGCGATCCTGAGCTGCAGGCGTTCGCCAAGGAGTGCAAGGAC

AAGAAGGAAGGTGGCCGGGTGAAGGGTATGCCGGAGACGATCCGCAGCCGTAGCATGCTTGTTGAAATCCT

CACCAGCATCATCTTTGTGTGTGGCCCTGGCCACGGAGCTATCAACTTCTCGCAATACGACTATATGTCGTTCG

TGCCCAACATGCCACTCGCGATTTATGAGGATATCCAGCTGCTCGCAGACCAAAAGGAGCCGGTTACGGAGG

CGCAGCTCATGTCGATCCTGCCAGACGGTGAAACCGCAGCCCGCCAGCTTGAGATTGTATACAACCTGACCGC

CTACAAGTTCGATAAGTTCGGGGATTATGACAGGACCTTCAAGGAGTGGTACGGCGAGACCTTTGAAGCCCA

TTTCAAGGACTACCCGCTCGTGATCCAGGGCTATCGGCAGCTCCAGGTTGCGCTGAGGCAGTCGGAGGTGGA

GATTAAGAAGCGCAACGCCAAACGCCCGAACAACTATCCGTACATGCAGCAGAGCGAGATGTTGAACAGCAT

CAGCATTTAA

Codon-optimized coding sequence of UfLOX2 by Genscript genetic codon frequency of *E. coli*

SEQ ID NO: 17

ATGCCGAGCATCAAACCGTGCCTGCCGGGTGACAGCGCGAACAGCGCGGCGCGTACCGCGAGCATCAAAGA

AAAGCGTGCGCAGATTGGTTACGATTATAAAATGCTGCCGAAGCTGGCGCTGGCGAGCGCTCCGCCGGCGAA

GTTCGTGGAGCTGAGCGACGCGTATATGGCGGAGCGTATTGGTGAAACCGCGAAATTCTTTAAAAACAAGGA

GATGACCAAGGCGCGTCGTATGTTTGATGTGGTTAACCGTATGGAAGACTTCAACGATTACTTTATTCTGCCGC

CGGTGATTGCGCCGGAGCACGCGAAGGGCAAGTGGATGGAGGACGATTTCTTTGCGGAACAGCGTCTGAGC

GGTGCGAACCCGCTGGTTCTGGCGAAACTGGACCGTGACGATGCGCGTGCGGAGATCCTGGAAGACATGAA

CCTGGATTTCAGCGTGAACAGCGAACTGAGCCGTGGCAACATTTACGTTTGCGACTATACCGGCACCGATCCG

ACCTACCGTGGTCCGTGCATGGTTACCGGTGGCGAAAACAACAGCGGTAAGAAAAAGTGGCTGCCGAAACCG

CTGAGCTGGTTTCGTTGGATCGAGGACGATAAAAACAAAGTGGGTGGCAAGCTGGTGCCGGTTGCGATTCAG

CTGGACGCGAGCGAAGATCCGGTGAACTACGTTCGTAAAGACAGCCGTGTTTATACCCCGAACGAGGAACAC

GAGTACGACTGGCTGTTCGCGAAGATCTGCGTGCAAGTTGCGGATAGCCTGCATCATGAGATGGGTAGCCAC

CTGGCGCGTTGCCACTTTACCATGGAACCGATCGCGGTGTGCGTTCACCGTACCATGGCGGAGGAACACCCG

ATTGCGCTGCTGCTGAACCTGCACATGCGTTTCCACATCGCGAACGATAGCGTGGCGGCGTATACCCTGATTG

-continued

GCCCGAGCGGTAACGTTGACGATCTGATGCCGGGCACCCTGCGTGAGAGCATGGCGCTGCTGACCGAAAGCT

ACGACAAGTGGGATCTGATCGGCACCAACTTCGAAAACGACCTGTTTAACCGTGAGGTGAACGACGATGAAC

GTCTGCCGCACTACCCGTATCGTGACGATGGTAAACTGATTTGGAAGATCATTGAGGATTGGGTGGAAAAAT

ACGTTAACGCGTTCTATGACAACGACGATGAGGTGGAAGGCGATCCGGAGCTGCAGGCGTTTGCGAAAGAG

TGCAAGGACAAAAAGGAAGGTGGCCGTGTTAAGGGTATGCCGGAGACCATCCGTAGCCGTAGCATGCTGGT

TGAGATTCTGACCAGCATCATTTTCGTTTGCGGTCCGGGCCACGGTGCGATCAACTTCAGCCAATACGATTATA

TGAGCTTTGTGCCGAACATGCCGCTGGCGATCTACGAGGACATTCAGCTGCTGGCGGATCAAAAAGAGCCGG

TTACCGAAGCGCAGCTGATGAGCATTCTGCCGGATGGTGAAACCGCGGCGCGTCAACTGGAAATTGTGTACA

ACCTGACCGCGTATAAATTCGATAAGTTTGGCGACTATGATCGTACCTTTAAAGAATGGTACGGCGAGACCTT

CGAAGCGCACTTTAAGGACTACCCGCTGGTTATCCAGGGTTATCGTCAGCTGCAAGTGGCGCTGCGTCAAAGC

GAGGTTGAAATTAAAAAGCGTAACGCGAAGCGTCCGAACAACTACCCGTATATGCAGCAAAGCGAGATGCTG

AACAGCATCAGCATTTAA

Amino acid Sequence for UfLOX2

SEQ ID NO: 18

MPSIKPCLPGDSANSAARTASIKEKRAQIGYDYKMLPKLALASAPPAKFVELSDAYMAERIGETAKFFKNKEMTKAR

RMFDVVNRMEDFNDYFILPPVIAPEHAKGKWMEDDFFAEQRLSGANPLVLAKLDRDDARAEILEDMNLDFSVNS

ELSRGNIYVCDYTGTDPTYRGPCMVTGGENNSGKKKWLPKPLSWFRWIEDDKNKVGGKLVPVAIQLDASEDPVN

YVRKDSRVYTPNEEHEYDWLFAKICVQVADSLHHEMGSHLARCHFTMEPIAVCVHRTMAEEHPIALLLNLHMRFH

IANDSVAAYTLIGPSGNVDDLMPGTLRESMALLTESYDKWDLIGTNFENDLFNREVNDDERLPHYPYRDDGKLIWK

IIEDWVEKYVNAFYDNDDEVEGDPELQAFAKECKDKKEGGRVKGMPETIRSRSMLVEILTSIIFVCGPGHGAINFSQ

YDYMSFVPNMPLAIYEDIQLLADQKEPVTEAQLMSILPDGETAARQLEIVYNLTAYKFDKFGDYDRTFKEWYGETFE

AHFKDYPLVIQGYRQLQVALRQSEVEIKKRNAKRPNNYPYMQQSEMLNSISI

3. Bacterial LOX

Codon-optimized coding sequence for WP_002738122.1

SEQ ID NO: 19

ATGGTGAACACCCCGCCGCCGACCCCGTGCCTGCCGCAGAACGAGCCGGATGCGAACCGTCGTGCGGATAGC

CTGAACCTGCAGCGTCAAGCGTACCGTTATGACTACCAGTATCTGCCGCCGCTGGTGCTGATGGAGAGCGTTC

CGGCGGCGGAAAACTTCAGCTTTCAATATATTACCGAACGTCTGGCGGCGACCGCGGAACTGCCGGCGAACA

TGCTGGCGGTGAAGGTTAAAAGCTTCCTGGACCCGCTGGATGAGCTGCAGGACTACGAAGATTTCTTTGCGAT

CATTCCGCTGCCGAAGATCGCGAAAGTGTATCAGACCAACGATGCGTTTGCGGAACAACGTCTGAGCGGTGC

GAACCCGCTGGTTCTGCACCTGCTGAAGCCGGGTGATGCGCGTGCGCAGGTTCTGAACCAAATTCCGAGCAG

CAAAACCGATTTCGAGCCGCTGTTTCAGGTTAACCAAGAACTGGCGGCGGGCAACATCTACATTGCGGACTAT

ACCGGCACCGATATCAACTACCTGGGTCCGAGCCTGATTCAGGGTGGCACCCACGCGAAGGGTCGTAAATAT

CTGCCGAAGCCGCGTGCGTTCTTTTGGTGGCGTAAGAGCGGCATCCGTGACCGTGGTAAACTGGTGCCGATC

GCGATTCAGTTCGGCGAGAACGCGGAAAAGCTGTACACCCCGTTCGAGAAAAACCCGCTGGCGTGGCTGTTT

GCGAAGATTTGCGTGCAAGTTGCGGATAGCAACCACCACGAAATGAACAGCCACCTGTGCCGTACCCACTTCG

TTATGGAGCCGATTGCGATTGGCACCGCGCGTCAGCTGGCGGAAAACCACCCGCTGAGCCTGCTGCTGAAAC

CGCACCTGCGTTTTATGCTGACCAACAACCACCTGGGTCAAGAGCGTCTGATCAACCCGGGTGGCCCGGTGGA

TGAGCTGCTGGCGGGCACCCTGGGTGAAAGCATGGCGCTGGTTAAGGACGCGTACGCGAACTGGAACCTGC

GTGATTTCGCGTTTCCGAAAGAGATTAGCAACCGTGGCATGGACGATACCGAACGTCTGCCGCACTACCCGTA

TCGTGACGATGGTATGCTGGTGTGGCAGAGCATCAACCAATTCGTTAGCGACTACCTGCACTACTTTTATCCGA

ACCCGCAGGACATTACCAACGATCAGGAGCTGCAAGCGTGGGCGGGTGAACTGAGCAACAGCGCGGCGGAT

CAAGGTGGCAACGTGAAGGGTATGCCGGCGAACTTCACCGACGTTGAGGATCTGATCGAAGTGGTTACCACC

-continued

ATCATTTTTATTTGCGGCCCGCTGCACAGCGCGGTTAACTACGGCCAGTACGACTATATGACCTTTGCGGCGAA

CATGCCGCTGGCGGCGTATTGCGACCTGCCGGAGGCGATCAAGGATACCACCGGTAGCATCATTGGCGACGC

GCGTGGTAGCATCACCGAAAAAGATATTCTGCAGCTGCTGCCGCCGTACAAGAAAGCGGCGGATCAGCTGCA

AAGCCTGTTCACCCTGAGCGACTACCGTTATGATCAACTGGGCTACTATGACAAGGCGTTTCGTGAGCTGTAT

GGTCGTAAATTCGAGGAAGTGTTTGCGGAAGGCGATCAGGCGACCATCACCGGTTTCCTGCGTCAATTTCAGC

AAAACCTGAACATGAACGAGCAGGAAATCGACGCGAACAACCAAAAGCGTATTGTTCCGTACACCTATCTGA

AACCGAGCCTGATTCTGAACAGCATCAGCATTTAA

Amino acid Sequence for WP_002738122.1

SEQ ID NO: 20

MVNTPPPTPCLPQNEPDANRRADSLNLQRQAYRYDYQYLPPLVLMESVPAAENFSFQYITERLAATAELPANMLA

VKVKSFLDPLDELQDYEDFFAIIPLPKIAKVYQTNDAFAEQRLSGANPLVLHLLKPGDARAQVLNQIPSSKTDFEPLFQ

VNQELAAGNIYIADYTGTDINYLGPSLIQGGTHAKGRKYLPKPRAFFWWRKSGIRDRGKLVPIAIQFGENAEKLYTPF

EKNPLAWLFAKICVQVADSNHHEMNSHLCRTHFVMEPIAIGTARQLAENHPLSLLLKPHLRFMLTNNHLGQERLIN

PGGPVDELLAGTLGESMALVKDAYANWNLRDFAFPKEISNRGMDDTERLPHYPYRDDGMLVWQSINQFVSDYL

HYFYPNPQDITNDQELQAWAGELSNSAADQGGNVKGMPANFTDVEDLIEVVTTIIFICGPLHSAVNYGQYDYMTF

AANMPLAAYCDLPEAIKDTTGSIIGDARGSITEKDILQLLPPYKKAADQLQSLFTLSDYRYDQLGYYDKAFRELYGRKF

EEVFAEGDQATITGFLRQFQQNLNMNEQEIDANNQKRIVPYTYLKPSLILNSISI

Codon-optimized coding sequence for WP_006635899.1

SEQ ID NO: 21

ATGGTGGATAACATGAAGCCGCTGCTGCCGCAAGACGATCCGAACCCGGAACAGCGTCACGACAGCCTGAAC

CGTCAGCAACAGGCGTACCAATTCGATTATGAAAGCCTGAGCCCGCTGGCGCTGCTGAAGGATGTGCCGGCG

GTTGAGAACTTTAGCAGCAAATACCTGGCGGAGCGTATCCTGGCGACCAGCGAACTGCCGGCGAACATGCTG

GCGGCGGACAGCCGTACCTTCCTGGACCCGCTGGATGAGCTGCAGGACTACGAAGATTTCTTTACCTGGCTGC

CGCTGCCGGGTGTGGCGAAAATCTATCAAACCGATCGTAGCTTTGCGGAACAGCGTCTGAGCGGTGCGAACC

CGATGGTTCTGCGTCTGCTGCACCAAGAGGACAGCCGTGCGGAAACCCTGGCGCAACTGTGCTGCCTGCAGC

CGCTGTTCGACCTGCGTAAGGAGCTGCAGGATAAAAACATCTACATTGCGGACTATACCGGCACCGATGAAC

ACTATCGTGGTCCGGCGAAGGTTGCGGGTGGCACCTACGAGAAGGGTCGTAAATATCTGCCGAAACCGCGTG

CGTTCTTTGCGTGGCGTTGGACCGGTATCCGTGATCGTGGCGAGATGACCCCGATCGCGATTCAACTGGACCC

GAAGCCGGGTAGCCACCTGTACACCCCGTTTGACCCGCCGATTGATTGGCTGTATGCGAAACTGTGCGTGCAG

GTTGCGGACGCGAACCACCACGAAATGAGCAGCCACCTGGGCCGTACCCACCTGGTGATGGAGCCGATCGCG

ATTGTTACCGCGCGTCAGCTGGCGAAGAACCACCCGCTGAGCCTGCTGCTGAAACCGCACTTCCGTTTTATGCT

GACCAACAACGATCTGGCGCGTAGCCATCTGATTGCGCCGGGTGGCCCGGTGGATGAACTGCTGGGTGGCAC

CCTGGCGGAGACCATGGAACTGACCCGTGAGGCGTGCAGCACCTGGAGCCTGGATGAGTTTGCGCTGCCGGC

GGAACTGAAGAACCGTGGTATGGACGATCCGAACCAGCTGCCGCACTACCCGTATCGTGACGATGGCCTGCT

GCTGTGGGATGCGATCGAAACCTTTGTTAGCGGTTACCTGAAGTTCTTTTATCCGACCAACGAGGGCATTGTG

CAAGACGTTGAACTGCAGACCTGGGCGAAAGAGCTGGCGAGCGACGATGGTGGCAAGGTGAAGGGTATGCC

GCACCACATCGACACCGTTGAGCAGCTGATCGCGATTGTGACCACCGTTATTTTCACCTGCGGCCCGCAACAC

AGCGCGGTGAACTTCCCGCAGTACGATTATATGAGCTTTGCGGCGAACATGCCGCTGGCGGCGTACCGTGAC

ATCCCGGGTATTACCGCGAGCGGCCACCTGGAAGTGATCACCGAAAACGATATTCTGCGTCTGCTGCCGCCGT

ATAAGCGTGCGGCGGACCAACTGCAGATCCTGTTCATTCTGAGCGCGTACCGTTATGACCGTCTGGGTTACTA

TGATAAAAGCTTTCGTGAACTGTACCGTATGAGCTTCGATGAGGTGTTTGCGGGCACCCCCGATCCAACTGCTG

GCGCGTCAGTTCCAACAGAACCTGAACATGGCGGAACAAAAGATCGACGCGAACAACCAGAAACGTGTGATT

-continued

CCGTATTTTGCGCTGAAACCGAGCCTGGTTCTGAACAGCATTAGCATGTAA

Amino acid Sequence for WP_006635899.1

SEQ ID NO: 22

MVDNMKPLLPQDDPNPEQRHDSLNRQQQAYQFDYESLSPLALLKDVPAVENFSSKYLAERILATSELPANMLAAD

SRTFLDPLDELQDYEDFFTWLPLPGVAKIYQTDRSFAEQRLSGANPMVLRLLHQEDSRAETLAQLCCLQPLFDLRKE

LQDKNIYIADYTGTDEHYRGPAKVAGGTYEKGRKYLPKPRAFFAWRWTGIRDRGEMTPIAIQLDPKPGSHLYTPFD

PPIDWLYAKLCVQVADANHHEMSSHLGRTHLVMEPIAIVTARQLAKNHPLSLLLKPHFRFMLTNNDLARSHLIAPG

GPVDELLGGTLAETMELTREACSTWSLDEFALPAELKNRGMDDPNQLPHYPYRDDGLLLWDAIETFVSGYLKFFYP

TNEGIVQDVELQTWAKELASDDGGKVKGMPHHIDTVEQLIAIVTTVIFTCGPQHSAVNFPQYDYMSFAANMPLA

AYRDIPGITASGHLEVITENDILRLLPPYKRAADQLQILFILSAYRYDRLGYYDKSFRELYRMSFDEVFAGTPIQLLARQF

QQNLNMAEQKIDANNQKRVIPYFALKPSLVLNSISM

Codon-optimized coding sequence for WP_015178512.1

SEQ ID NO: 23

ATGGTGGACAACATGAAGCCGAGCCTGCCGCAAGACGATCCGAACCAAGAACAGCGTAAAGACAGCCTGAA

CCGTCAGCAACAGGCGTACCAGTTCGATTATGAGAGCCTGAGCCCGCTGGCGCTGCTGAAGAACGTGCCGGC

GGTTGAAAACTTTAGCAGCAAATACATCGGCGAGCGTATTCTGGCGACCAGCGAACTGCCGGCGAACATGCT

GGCGGCGGACAGCCGTACCTTCCTGGACCCGCTGGATGAGCTGCAAGACTACGAAGATTTCTTTACCCTGCTG

CCGCTGCCGGCGGTGGCGAAGATTTATCAAACCGATCGTAGCTTTGCGGAACAGCGTCTGAGCGGTGCGAAC

CCGATGGTTCTGCGTCTGCTGGATGCGGGTGATCCGCGTGCGCAAACCCTGGCGCAGATCAGCAGCTTCCACC

CGCTGTTTGACCTGGGCCAGGAGCTGCAACAGAAAAACATTTACGTTGCGGACTATACCGGCACCGATGAGC

ACTACCGTGCGCCGAGCAAGATCGGTGGCGGTAGCTATGAAAAGGGCCGTAAATTCCTGCCGAAACCGCGTG

CGTTCTTTGCGTGGCGTTGGACCGGCATCCGTGACCGTGGTGAGATGACCCCGATCGCGATTCAACTGGACCC

GACCCCGGATAGCCATGTGTACACCCCGTTTGACCCGCCGGTTGATTGGCTGTTTGCGAAGCTGTGCGTGCAG

GTTGCGGATGCGAACCACCACGAGATGAGCAGCCACCTGGGTCGTACCCACCTGGTGATGGAACCGATCGCG

ATTGTTACCGCGCGTCAACTGGCGCAGAACCACCCGCTGAGCCTGCTGCTGAAACCGCACTTCCGTTTTATGCT

GACCAACAACGAGCTGGCGCGTAGCTATCTGATTGCGCCGGGCGGTCCGGTGGATGAACTGCTGGGTGGCAC

CCTGCCGGAGACCATGGAAATTGCGCGTGAGGCGTGCAGCACCTGGAGCCTGGATGAGTTTGCGCTGCCGGC

GGAACTGAAGAACCGTGGCATGGACGATACCAACCAGCTGCCGCACTACCCGTATCGTGACGATGGCCTGCT

GCTGTGGGACGCGATTGAGACCTTTGTTAGCGGTTACCTGAAATTCTTTTATCCGACCGAAATCGCGATTGTG

CAAGACGTTGAGCTGCAAACCTGGGCGCAGGAACTGGCGAGCGATCGTGGCGGTAAAGTGAAAGGCATGCC

GCCGCGTATCAACACCGTGGAACAGCTGATCAAGATTGTTACCACCATCATTTTCACCTGCGGTCCGCAACACA

GCGCGGTTAACTTCCCGCAGTACGAGTATATGAGCTTTGCGGCGAACATGCCGCTGGCGGCGTACCGTGATAT

CCCGAAGATTACCGCGAGCGGTAACCTGGAAGTGATCACCGAAAAAGACATTCTGCGTCTGCTGCCGCCGTAT

AAGCGTGCGGCGGATCAGCTGAAAATCCTGTTCACCCTGAGCGCGTACCGTTATGACCGTCTGGGCTACTATG

ATAAGAGCTTTCGTGAGCTGTACCGTATGAGCTTCGACGAAGTTTTTGCGGGCACCCCGATTCAACTGCTGGC

GCGTCAGTTTCAACAGAACCTGAACATGGCGGAACAAAAGATCGATGCGAACAACCAGAAACGTGTGATCCC

GTATATTGCGCTGAAACCGAGCCTGGTTATCAACAGCATTAGCATGTAA

Amino acid Sequence for WP_015178512.1

SEQ ID NO: 24

MVDNMKPSLPQDDPNQEQRKDSLNRQQQAYQFDYESLSPLALLKNVPAVENFSSKYIGERILATSELPANMLAAD

SRTFLDPLDELQDYEDFFTLLPLPAVAKIYQTDRSFAEQRLSGANPMVLRLLDAGDPRAQTLAQISSFHPLFDLGQEL

QQKNIYVADYTGTDEHYRAPSKIGGGSYEKGRKFLPKPRAFFAWRWTGIRDRGEMTPIAIQLDPTPDSHVYTPFDP

PVDWLFAKLCVQVADANHHEMSSHLGRTHLVMEPIAIVTARQLAQNHPLSLLLKPHFRFMLTNNELARSYLIAPG

GPVDELLGGTLPETMEIAREACSTWSLDEFALPAELKNRGMDDTNQLPHYPYRDDGLLLWDAIETFVSGYLKFFYP

-continued

TEIAIVQDVELQTWAQELASDRGGKVKGMPPRINTVEQLIKIVTTIIFTCGPQHSAVNFPQYEYMSFAANMPLAAY
RDIPKITASGNLEVITEKDILRLLPPYKRAADQLKILFTLSAYRYDRLGYYDKSFRELYRMSFDEVFAGTPIQLLARQFQ
QNLNMAEQKIDANNQKRVIPYIALKPSLVINSISM

Codon-optimized coding sequence for WP_015204462.1

SEQ ID NO: 25

ATGCCGCAACCGTACCTGCCGCAGAACGAGCCGAACCCGGAAAAACGTAACAACGACCTGAGCGATCAGCAA
CAGGCGTACGAGTATGATTACAAGTATCTGCCGCCGCTGGTGCTGCTGAAGAAAATTCCGGCGTTCGAAAACT
TTAGCGCGCAGTACATCGCGGAACGTGTGGTTGCGACCAGCGAGCTGGTTCCGAACATGCTGGCGGCGAAAG
CGCGTAGCTTTCTGGACCCGCTGGACGATATCAAGGACTACGAGGACCTGTTCACCCTGCTGCCGCTGCCGGA
AGTGGCGAAAGTTTATCAAACCAACAACAGCTTTGCGGAGCAGCGTCTGAGCGGTGCGAACCCGTTCGTGAT
TCGTCTGCTGGACGAGGACGATCCGCGTAGCCAAGTTCTGGAACAGATCCCGAGCTTCAAAGACGATTTTGA
GCCGCTGTTCGATGTGCGTAAGGAACTGGCGGCGGGTAACATCTACATTACCGACTATACCGGCACCGATGA
GTACTATCGTGGCCCGAGCATGGTTCAGGGTGGCACCTACGAAAAGGGCCGTAAATATCTGCCGAAACCGCT
GGCGTTCTTTTGGTGGCAACGTACCGGTATTAGCGACCGTGGCAAGCTGGTGCCGATCGCGATTCAGCTGGA
TGCGAGCAAGAACAGCAAAGTGTACACCCCGACCAACAGCAAAGTTTATACCCCGTTTGAGCAAAACCCGCTG
GACTGGCTGTTCGCGAAGCTGTGCGTGCAGATCGCGGATGGTAACCACCACGAAATGAGCAGCCACCTGTGC
CGTACCCACTTCGTTATGGAGCCGATTGCGATTGGCACCGCGCACCAGCTGGCGGAAAACCACCCGCTGAGCC
TGCTGCTGCGTCCGCACTTCCTGTTTATGCTGACCAACAACCACCTGGGCCAACAGCGTCTGATCAACCCGGGT
GGCCCGGTGGATGAGCTGCTGGCGGGCACCCTGCCGGAGAGCATGGAACTGGTTAAGGATGCGTACGAGGG
CTGGAACATTAAAGAATTCGCGTTTCCGACCGAGATCAAGAACCGTGGTATGGACAACACCGAACGTCTGCC
GCACTACCCGTATCGTGACGATGGCATGCTGGTTTGGAAAGCGATTCACACCTTTGTGAGCGATTACGTTAAC
CACTTCTATCCGACCCCGGAAGACATCACCGGTGATACCGAGCTGCAAGCGTGGGCGAAGGAACTGAGCGAC
CAAAGCGCGCAGACCAACGGTGGCAAGGTGAAAGGCATGCCGACCAGCTTTACCACCGTGCAGGAGCTGAT
CGAAATTGTTACCACCATCATTTTCATTTGCGGTCCGCAACACAGCGCGGTTAACTACGCGCAGGATGGCTATA
TGACCTTTGCGGCGAACATGCCGCTGGCGGCGTACCGTGACATCCCGAAGCAGAGCCACAAACCGCAGGATC
AACCGACCGCGACCCCGAGCGTGGCGGTTCAAACCACCGCGGAGCAGACCACCGCGGAACAAACCAAGGCG
GTGGAAATTACCGCGGACAAAGCGACCCTGGATCAGAACACCGTTCTGCAAAAACGTGCGGTGCAGACCACC
ACCGTTGAGATCCCGGAAGACCAAATTACCGAGGAACAGATCCTGAAGCTGCTGCCGCCGTACAAACGTACC
GCGGACCAACTGCAGAGCCTGTTTGTGCTGAGCGCGTACCAATATGATCGTCTGGGTTACTATGAGAAGGCG
TTCCAACAGCTGTACAACGACAAGTTCGAAGATGTTTTCAAGGACGATAACAACCAAGCGATCATTGCGATTG
TGCGTCAGTTCCAACAGAACCTGAACATGGTTGAGCAGGAAATCGACGCGAACAACAAGAAACGTGTGGTTC
CGTACCTGTATCTGAAGCCGAGCCTGATCCTGAACAGCATCAGCATTTAA

Amino acid Sequence for WP_015204462.1

SEQ ID NO: 26

MPQPYLPQNEPNPEKRNNDLSDQQQAYEYDYKYLPPLVLLKKIPAFENFSAQYIAERVVATSELVPNMLAAKARSF
LDPLDDIKDYEDLFTLLPLPEVAKVYQTNNSFAEQRLSGANPFVIRLLDEDDPRSQVLEQIPSFKDDFEPLFDVRKELA
AGNIYITDYTGTDEYYRGPSMVQGGTYEKGRKYLPKPLAFFWWQRTGISDRGKLVPIAIQLDASKNSKVYTPTNSKV
YTPFEQNPLDWLFAKLCVQIADGNHHEMSSHLCRTHFVMEPIAIGTAHQLAENHPLSLLLRPHFLFMLTNNHLGQ
QRLINPGGPVDELLAGTLPESMELVKDAYEGWNIKEFAFPTEIKNRGMDNTERLPHYPYRDDGMLVWKAIHTFVS
DYVNHFYPTPEDITGDTELQAWAKELSDQSAQTNGGKVKGMPTSFTTVQELIEIVTTIIFICGPQHSAVNYAQDGY
MTFAANMPLAAYRDIPKQSHKPQDQPTATPSVAVQTTAEQTTAEQTKAVEITADKATLDQNTVLQKRAVQTTTV

-continued

EIPEDQITEEQILKLLPPYKRTADQLQSLFVLSAYQYDRLGYYEKAFQQLYNDKFEDVFKDDNNQAIIAIVRQFQQNL

NMVEQEIDANNKKRVVPYLYLKPSLILNSISI

Codon-optimized coding sequence for WP_028091425.1

SEQ ID NO: 27

ATGCAGCCGTTCCTGCCGCAAAACGACCCGAACCCGAGCCAGCGTCAAAGCAGCCTGGAGAAGGGTCGTAAG

GAATACCAGTTCATGTACGATTTTCTGCCGCCGATGGCGATGATCAAGAGCGTGCCGCCGGCGGAGAACTTTA

GCACCAAATACATTGCGGAACGTACCCTGGAGGCGGCGGAACTGCCGCTGAACATGATGGCGGTTAAGACCC

ACGCGATGTGGGACCCGCTGGATGAGCTGCAGGACTACGAAGATTTCTTTCCGGTGCTGCAAAAGCCGAACG

TTATGAAAACCTATGAGACCGACGATAGCTTCGCGGAACAGCGTCTGTGCGGCGTGAACCCGATGGTTCTGC

GTCAGATCAAGCAAATGCCGGCGAACTTCGCGTTTACCATTGAGGAACTGCAAGACAAATTCGGTAGCAGCA

TCAACCTGATTGAGCGTCTGGCGACCGGCAACCTGTACGTGGCGGATTATCGTAGCCTGGCGTTTATCCAGGG

TGGCACCTACGCGAAGGGTAAGAAATATCTGCCGGCGCCGCTGGCGTTCTTTTGCTGGCGTACCAGCGGTTTC

CAGGACCGTGGCCAACTGGTGCCGGTTGCGATCCAGATTAACCCGAAAGCGGGTAAAGCGAGCCCGCTGCTG

ACCCCGTTTGATGATCCGCTGACCTGGTTTTACGCGAAAAGCTGCGTGCAAATCGCGGATGCGAACCACCACG

AGATGAGCAGCCACCTGTGCCGTACCCACCTGGTTATGGAGCCGTTTGCGGTGGTTACCCCGCGTCAGCTGGC

GGAAAACCACCCGCTGCGTATTCTGCTGAAGCCGCACTTCCGTTTTATGCTGGCGAACAACGACCTGGCGCGT

AAACGTCTGGTTAGCCGTGGTGGCTTCGTTGATGAGCTGCTGGCGGGCACCCTGCAGGAAAGCCTGCAAATC

GTGGTTGACGCGTACAAAAGCTGGAGCCTGGATCAGTTTGCGCTGCCGCGTGAACTGAAGAACCGTGGTGTG

AACGACGTTAAAAACCTGCCGCACTACCCGTATCGTGACGATGGCATCCTGCTGTGGAACGCGATTAACAAGT

TCGTTTTTAACTATCTGCAGCTGTACTATCAAAGCAGCGCGGACCTGAAGGCGGATGCGGAACTGCAGGCGT

GGGCGCGTGAACTGGTGGCGCAAGATGGTGGCCGTGTTAAGGGTATGAGCGACCGTATCGATACCCTGGAG

CAGCTGGTTGAGATCGTTACCACCATCATTTACATTTGCGGCCCGCAGCACAGCGCGGTGAACTTCAGCCAAT

ACGAATATATGGGCTTTATTCCGAACATGCCGCTGGCGGCGTATCAGCCGATCCAGCAAAAGGGTGACATTAA

AGATCGTCAAGCGCTGATCGACTTCCTGCCGCCGGCGAAACCGACCAGCACCCAGCTGAGCACCGTTTACATT

CTGAGCGACTACCGTTATGATCGTCTGGGCTACTATGAGGAAGAGGAATTCACCGACCCGAACGCGGATCAG

GTGGTTAACAAGTTTCAGCAAGAGCTGAACATGGTGCAGCGTAAGATCGAACTGAACAACAAACGTCGTCTG

GTTAACTACAAATATCTGCAACCGCGTCTGATTCTGAACAGCATCAGCATTTAA

Amino acid Sequence for WP_028091425.1

SEQ ID NO: 28

MQPFLPQNDPNPSQRQSSLEKGRKEYQFMYDFLPPMAMIKSVPPAENFSTKYIAERTLEAAELPLNMMAVKTHA

MWDPLDELQDYEDFFPVLQKPNVMKTYETDDSFAEQRLCGVNPMVLRQIKQMPANFAFTIEELQDKFGSSINLIE

RLATGNLYVADYRSLAFIQGGTYAKGKKYLPAPLAFFCWRTSGFQDRGQLVPVAIQINPKAGKASPLLTPFDDPLT

WFYAKSCVQIADANHHEMSSHLCRTHLVMEPFAVVTPRQLAENHPLRILLKPHFRFMLANNDLARKRLVSRGGFV

DELLAGTLQESLQIVVDAYKSWSLDQFALPRELKNRGVNDVKNLPHYPYRDDGILLWNAINKFVFNYLQLYYQSSA

DLKADAELQAWARELVAQDGGRVKGMSDRIDTLEQLVEIVTTIIYICGPQHSAVNFSQYEYMGFIPNMPLAAYQPI

QQKGDIKDRQALIDFLPPAKPTSTQLSTVYILSDYRYDRLGYYEEEEFTDPNADQVVNKFQQELNMVQRKIELNNKR

RLVNYKYLQPRLILNSISI

Codon-optimized coding sequence for OBQ01436.1

SEQ ID NO: 29

ATGCAGCCGTTCCTGCCGCAAAACGACCCGAACCCGGCGCAGCGTCAAAGCTGCCTGGAGAAGGGTCGTAAG

GAATACCAGTTCATGTACGATTTTCTGCCGCCGATGGCGATGCTGAAGAGCGTTCCGCCGGCGGAGAACTTTA

GCACCAAATACATCGCGGAACGTACCCTGGAGGCGGCGGAACTGCCGCTGAACATGATGGCGGTGAAGACC

CACGCGATGTGGGACCCGCTGGATGAGCTGCAGGACTACGAAGATTTCTTTCCGATTCTGCAAAAGCCGAAC

-continued

GTTATGAAAACCTATGAGACCGACGATAGCTTCGCGGAACAGCGTCTGTGCGGCGTGAACCCGATGGTTCTG

CGTCAGATCAAGCAAATGCCGGCGAACTTCGCGTTTACCATTGAGGAACTGCAAGCGAAATTCGGTAACAGC

ATCAACCTGATTGAGCGTCTGGCGACCGGCAACCTGTACGTGGCGGACTATCGTAGCCTGGCGTTTATCCAGG

GTGGCACCTACGCGAAGGGTAAGAAATATCTGCCGGCGCCGCTGGCGTTCTTTTGCTGGCGTAGCAGCGGTT

TCCAGGATCGTGGCCAACTGGTGCCGGTTGCGATCCAGATTAACCCGAAAGCGGGTAAAGCGAGCCCGCTGC

TGACCCCGTTTGATGATCCGCTGACCTGGTTTTACGCGAAAAGCTGCGTGCAAATCGCGGACGCGAACCACCA

CGAGATGAGCAGCCACCTGTGCCGTACCCACCTGGTTATGGAGCCGTTTGCGGTGGTTACCCCGCGTCAGCTG

GCGGAAAACCACCCGCTGCGTATTCTGCTGCGTCCGCACTTCCGTTTTATGCTGGCGAACAACGACCTGGCGC

GTAAGCGTCTGGTTAGCCGTGGTGGCTTCGTTGATGAGCTGCTGGCGGGCACCCTGCAGGAAAGCCTGCAAA

TCGTGGTTGACGCGTACAAAAGCTGGAGCCTGGATCAGTTTGCGCTGCCGCGTGAACTGAAGAACCGTGGTG

TGGACGATGTTAAAAACCTGCCGCACTACCCGTATCGTGACGATGGCATCCTGCTGTGGAACGCGATTAACAA

GTTCGTTTTTAACTATCTGCAGCTGTACTATAAGAGCCCGGCGGACCTGAAGGCGGATGGTGAACTGCAGGC

GTGGGCGCGTGAACTGGTGGCGCAAGACGGTGGCCGTGTTAAAGGCATGAGCGACCGTATCGATACCCTGG

AGCAACTGGTGGAAATCGTTACCACCATCATTTACATTTGCGGCCCGCAGCACAGCGCGGTGAACTTCAGCCA

ATACGAGTATATGGGCTTTATTCCGAACATGCCGCTGGCGGCGTATCAGGAGATCCAGCAAAACGGTGACATT

GAAGATCGTCAAGCGCTGATCGATTTCCTGCCGCCGGCGAAGCCGACCAACACCCAGCTGAGCACCGTTTACA

TTCTGAGCGACTACCGTTATGATCGTCTGGGCTACTATGAGGAAGAGGAATTCACCGACCCGAACGCGGATCA

GGTGGTTAACAAATTTCAGCAAGAGCTGAGCGTGGTTCAGCGTAAGATCGAACTGAACAACAAAGGTCGTCT

GGTGAACTACGAATATCTGCAACCGGGCCTGATTCTGAACAGCATCAGCATTTAA

Amino acid Sequence for OBQ01436.1

SEQ ID NO: 30

MQPFLPQNDPNPAQRQSCLEKGRKEYQFMYDFLPPMAMLKSVPPAENFSTKYIAERTLEAAELPLNMMAVKTHA

MWDPLDELQDYEDFFPILQKPNVMKTYETDDSFAEQRLCGVNPMVLRQIKQMPANFAFTIEELQAKFGNSINLIE

RLATGNLYVADYRSLAFIQGGTYAKGKKYLPAPLAFFCWRSSGFQDRGQLVPVAIQINPKAGKASPLLTPFDDPLT

WFYAKSCVQIADANHHEMSSHLCRTHLVMEPFAVVTPRQLAENHPLRILLRPHFRFMLANNDLARKRLVSRGGFV

DELLAGTLQESLQIVVDAYKSWSLDQFALPRELKNRGVDDVKNLPHYPYRDDGILLWNAINKFVFNYLQLYYKSPA

DLKADGELQAWARELVAQDGGRVKGMSDRIDTLEQLVEIVTTIIYICGPQHSAVNFSQYEYMGFIPNMPLAAYQEI

QQNGDIEDRQALIDFLPPAKPTNTQLSTVYILSDYRYDRLGYYEEEEFTDPNADQVVNKFQQELSVVQRKIELNNKG

RLVNYEYLQPGLILNSISI

Codon-optimized coding sequence for OBQ25779.1

SEQ ID NO: 31

ATGATCAACATTATGCAGCCGTTCCTGCCGCAAAACGACCCGAACCCGGGTCAGCGTCAAAGCAGCCTGGAG

AAGGGCCGTAAGGAATACCAGTTCATGTACGATTTTCTGCCGCCGATGGCGATGCTGAAGAGCGTGCCGCCG

GCGGAGAACTTTAGCACCAAATACATCGCGGAACGTACCCTGGAGGCGGCGGAACTGCCGCTGAACATGATG

GCGGTTAAGACCCACGCGATGTGGGACCCGCTGGATGAGCTGCAGGACTACGAAGATTTCTTTCCGGTGCTG

CAAAAGCCGAACGTTATGAAAACCTATGAGACCGACGATAGCTTCGCGGAACAGCGTCTGTGCGGTGTGAAC

CCGATGGTTCTGCGTCAGATCAAGCAAATGCCGGCGAACTTCGCGTTTACCATTGAGGAACTGCAAGCGAAAT

TCGGTAACAGCATCAACCTGATTGAGCGTCTGGCGACCGGCAACCTGTACGTTGCGGACTATCGTAGCCTGGC

GTTTATCCAGGGTGGCACCTACGCGAAGGGTAAGAAATATCTGCCGGCGCCGCTGGCGTTCTTTTGCTGGCGT

AGCAGCGGTTTCCAGGATCGTGGCCAACTGGTGCCGGTTGCGATCCAGATTAACCCGAAAGCGGGTCAAGCG

AGCCCGCTGCTGACCCCGTTTGACAAGCCGCTGACCTGGTTTTACGCGAAAAGCTGCGTGCAGATCGCGGATG

CGAACCACCACGAGATGAGCAGCCACCTGTGCCGTACCCACCTGGTTATGGAGCCGTTTGCGGTGGTTACCCC

GCGTCAACTGGCGGAAAACCACCCGCTGCGTATTCTGCTGAAGCCGCACTTCCGTTTTATGCTGGCGAACAAC

-continued

GACCTGGCGCGTAAACGTCTGGTTAGCCGTGGTGGCTTCGTTGATGAGCTGCTGGCGGGCACCCTGCAGGAA

AGCCTGCAAATCGTGGTTGACGCGTACAAAAGCTGGAGCCTGGATCAGTTTGCGCTGCCGCGTGAACTGAAG

AACCGTGGTGTGGACGATGTTAAAAACCTGCCGCACTACCCGTATCGTGACGATGGCATCCTGCTGTGGAACG

CGATTAACAAGTTCGTGTTTAACTATCTGCAGCTGTACTATAAGAGCCCGGCGGACCTGAAGGCGGATGGTGA

ACTGCAGGCGTGGGCGCGTGAACTGGTGGCGCAAGACGGTGGCCGTGTTAAAGGCATGAGCGACCGTATCG

ATACCCTGGAGCAACTGGTGGAAATCGTTACCACCATCATTTACATTTGCGGCCCGCAGCACAGCGCGGTGAA

CTTCAGCCAATACGAGTATATGGGCTTTATTCCGAACATGCCGCTGGCGGCGTATCAGGCGATCCAGCAAAAG

GGCGACATTAAAGATCGTCAAGCGCTGATCGACTTCCTGCCGCCGGCGAAGCCGACCAACACCCAGCTGAGC

ACCGTTTACATTCTGAGCGACTACCGTTATGATCGTCTGGGTTACTATGAGGAAGAGGAATTCACCGACCCGA

ACGCGGATCAGGTGGTTAACAAATTTCAGCAAGAGCTGAACGTGGTTCAGCGTAAGATCGAACTGAACAACA

AAGGCCGTCTGGTGAACTACGAATATCTGCAGCCGCGTCTGATTCTGAACAGCATCAGCATTTAA

Amino acid Sequence for OBQ25779.1

SEQ ID NO: 32

MINIMQPFLPQNDPNPGQRQSSLEKGRKEYQFMYDFLPPMAMLKSVPPAENFSTKYIAERTLEAAELPLNMMAV

KTHAMWDPLDELQDYEDFFPVLQKPNVMKTYETDDSFAEQRLCGVNPMVLRQIKQMPANFAFTIEELQAKFGNS

INLIERLATGNLYVADYRSLAFIQGGTYAKGKKYLPAPLAFFCWRSSGFQDRGQLVPVAIQINPKAGQASPLLTPFDK

PLTWFYAKSCVQIADANHHEMSSHLCRTHLVMEPFAVVTPRQLAENHPLRILLKPHFRFMLANNDLARKRLVSRG

GFVDELLAGTLQESLQIVVDAYKSWSLDQFALPRELKNRGVDDVKNLPHYPYRDDGILLWNAINKFVFNYLQLYYKS

PADLKADGELQAWARELVAQDGGRVKGMSDRIDTLEQLVEIVTTIIYICGPQHSAVNFSQYEYMGFIPNMPLAAY

QAIQQKGDIKDRQALIDFLPPAKPTNTQLSTVYILSDYRYDRLGYYEEEEFTDPNADQVVNKFQQELNVVQRKIELN

NKGRLVNYEYLQPRLILNSISI

Codon-optimized coding sequence for WP_039200563.1

SEQ ID NO: 33

ATGAAGCCGTTCCTGCCGCAGAACGATCCGAACCCGACCCAGCGTCAAAGCAGCCTGGAGAAGGGCCGTAAA

GAGTACGAATTCCGTTATGACTTTCTGCCGCCGATGGCGATGCTGAAGAACGTGCCGCCGAGCGAGAACTTTA

GCACCAAATACATTGCGGAACGTACCATCGAGACCGCGGAACTGCCGAGCAACATGATGGCGGTTAAAGCGC

ACGCGATGTGGGACCCGCTGGATGAGCTGCAGGACTACGAAGATTTCTTTCCGGTGCTGCAAAAGCCGAACG

TTATGAAAAACTATGAGACCGACGATAGCTTCGCGGAACAGCGTCTGTGCGGTGTGAACCCGGTGGTTCTGT

GCCAGATTAAGCAAATGCCGGCGAACTTCGCGTTTACCATCGAGGAACTGCAAGCGAAATTTGGTAACAGCA

TTGATCTGCGTGAGCGTCTGGCGACCGGCAACCTGTACGTGGCGGACTATCGTCCGCTGGCGTTCATCCGTGG

TGGCACCTTTGCGAAGGGTAAGAAATACCTGCCGGCGCCGCTGGCGTTCTTTTGCTGGCGTAGCAGCGGTTTC

CAGGATCGTGGCCAACTGGTTCCGATCGCGATTCAGATCAACCCGAAGGAAGGCAAAGCGAGCCCGCTGCTG

ACCCCGTTCGACGATAGCAGCACCTGGTTTTACGCGAAGAGCTGCGTGCAAATCGCGGACGCGAACCACCAC

GAGATGAGCAGCCACCTGTGCCGTACCCACTTCGTTATGGAACCGTTTGCGGTGGTTACCCCGCGTCAGCTGG

CGCAAAACCACCCGCTGCGTATTCTGCTGAAACCGCACTTCCGTTTTATGCTGGCGAACAACGATCTGGGTCGT

CAGCGTCTGGTGAACCGTGGTGGCCCGGTTGATGAGCTGCTGGCGGGCACCCTGCAGGAAAGCCTGCAAATT

GTGGTTGACGCGTACACCGATTGGCGTCTGGACCAATTCGCGCTGCCGACCGAGCTGAAGAACCGTGGTGTG

GACGATGTTAAAAACCTGCCGCACTACCCGTATCGTGACGATGGCATTCTGCTGTGGAACGCGATCAACAAGT

TCGTGTTCAACTACCTGGAACTGTACTACAAGAGCCCGGCGGATCTGACCGCGGATGTTGAACTGCAGGCGT

GGGCGCGTGAACTGGTGGCGCAAGATGGTGGCCGTGTTAAGGGTATGAGCGACCGTATTGATACCCTGAAA

CAGCTGGTTGAGATCGTTACCACCATCATTTACACCTGCGGTCCGCTGCACAGCGCGGTGAACTTCCCGCAGT

ACGAATATATGGGCTTTATCCCGAACATGCCGCTGGCGGCGTATCAACCGATTAAGAAAGAGGGTGTTTGCAC

-continued

CCGTAAGGAACTGATCGACTTCCTGCCGGCGGCGAAACCGACCAGCAGCCAGCTGACCACCCTGTTTACCCTG

AGCGCGTACCGTTATGATCGTCTGGGCTACTATGAGGAAGAGGAATTCGAGGACCCGAACGCGGACGATGTG

GTTAACAAATTTCAGCAAGAGCTGAACGTGGTTCAGCGTAAGATCGAACTGAGCAACAAAGGTCGTCTGGTT

AACTACGAATATCTGCAACCGCGTCTGATTCTGAACAGCATTAGCATCTAA

Amino acid Sequence for WP_039200563.1

SEQ ID NO: 34

MKPFLPQNDPNPTQRQSSLEKGRKEYEFRYDFLPPMAMLKNVPPSENFSTKYIAERTIETAELPSNMMAVKAHAM

WDPLDELQDYEDFFPVLQKPNVMKNYETDDSFAEQRLCGVNPVVLCQIKQMPANFAFTIEELQAKFGNSIDLRER

LATGNLYVADYRPLAFIRGGTFAKGKKYLPAPLAFFCWRSSGFQDRGQLVPIAIQINPKEGKASPLLTPFDDSSTWFY

AKSCVQIADANHHEMSSHLCRTHFVMEPFAVVTPRQLAQNHPLRILLKPHFRFMLANNDLGRQRLVNRGGPVDE

LLAGTLQESLQIVVDAYTDWRLDQFALPTELKNRGVDDVKNLPHYPYRDDGILLWNAINKFVFNYLELYYKSPADLT

ADVELQAWARELVAQDGGRVKGMSDRIDTLKQLVEIVTTIIYTCGPLHSAVNFPQYEYMGFIPNMPLAAYQPIKKE

GVCTRKELIDFLPAAKPTSSQLTTLFTLSAYRYDRLGYYEEEEFEDPNADDVVNKFQQELNVVQRKIELSNKGRLVNY

EYLQPRLILNSISI

Codon-optimized coding sequence for WP_012407347.1

SEQ ID NO: 35

ATGAAGCCGTACCTGCCGCAGAACGACCCGGATCCGACCAAACGTCAGATCCTGCTGGAGCGTAACCAAGGC

GAGTACGAATTCGACTATGATTTTCTGGTGCCGATGGCGATGCTGAAGAACGTTCCGAGCATTGAGAACTTCA

GCACCAAATATATCGCGGAACGTACCCTGGAGACCGCGGAACTGCCGATTAACATGCTGGCGGTGAAGACCC

GTAGCCTGTGGGACCCGCTGGATGAGCTGCAGGACTACGAAGATTATTTTCCGGTTCTGCCGAAGCCGAACAT

CATTAAAACCTACCAGAGCGACGATAGCTTCTGCGAGCAACGTCTGTGCGGTGCGAACCCGTTTGTGCTGCGT

CGTATTGAACAGATGCCGGACGGCTTCGCGTTTACCATCCTGGAGCTGCAAGAAAAGTTCGGTGATAGCATTA

ACCTGGTTGAGAAACTGGCGAACGGCAACCTGTACGTGGCGGACTATCGTGCGCTGGCGTTCGTTAAAGGTG

GCAGCTACGAACGTGGTAAGAAATTTCTGCCGACCCCGATCGCGTTCTTTTGCTGGCGTAGCAGCGGTTTCAG

CGACCGTGGCCAGCTGGTGCCGATCGTTATTCAAATCAACCCGGCGGATGGCAAGCAGAGCCAACTGATCAC

CCCGTTCGACGATCCGCTGACCTGGTTTCACGCGAAACTGTGCGTGCAGATTGCGGACGCGAACCACCACGAA

ATGAGCAGCCACCTGTGCCGTACCCACTTCGTGATGGAGCCGTTTGCGATTGTTACCGCGCGTCAACTGGCGG

AAAACCACCCGCTGAGCCTGCTGCTGAAGCCGCACTTCCGTTTTATGCTGGCGAACAACGACCTGGCGCGTAA

ACGTCTGATCAGCCGTGGTGGCCCGGTGGATGAGCTGCTGGCGGGCACCCTGCAGGAAAGCCTGCAAATTGT

GGTTAACGCGTACACCGAGTGGAGCCTGGACCAGTTCAGCCTGCCGACCGAACTGAAGAACCGTGGTATGGA

CGATCCGGATAACCTGCCGCACTACCCGTATCGTGACGATGGCCTGCTGCTGTGGAACGCGATTAAGAAATTT

GTTAGCGAGTATCTGCAGATCTACTATAAGACCCCGCAAGACCTGGCGGAGGATCTGGAACTGCAGAGCTGG

GTGCAAGAACTGGTTAGCCAGAGCGGTGGCCGTGTGAAAGGTATTAGCGACCGTATCAACACCCTGGACCAA

CTGGTGGATATTGCGACCGCGGTTATTTTTACCTGCGGTCCGCAGCATGCGGCGGTTAACTACAGCCAATACG

AGTATATGACCTTTATGCCGAACATGCCGCTGGCGGCGTATAAACAGATGACCAGCGAAGGCACCATCCCGG

ATCGTAAGAGCCTGCTGAGCTTCCTGCCGCCGAGCAAACAGACCGCGGACCAACTGAGCATTCTGTTTATCCT

GAGCGCGTACCGTTATGATCGTCTGGGCTACTATGACGATAAGTTCCTGGACCCGGAGGCGCAAGATGTTCTG

GCGAAATTTCAGCAAGAACTGAACGAGGCGGAACGTGAGATTGAACTGAACAACAAGAGCCGTCTGATCAAC

TACAACTATCTGAAACCGCGTCTGGTGACCAACAGCATCAGCGTTTAA

Amino acid Sequence for WP_012407347.1

SEQ ID NO: 36

MKPYLPQNDPDPTKRQILLERNQGEYEFDYDFLVPMAMLKNVPSIENFSTKYIAERTLETAELPINMLAVKTRSLWD

PLDELQDYEDYFPVLPKPNIIKTYQSDDSFCEQRLCGANPFVLRRIEQMPDGFAFTILELQEKFGDSINLVEKLANGN

LYVADYRALAFVKGGSYERGKKFLPTPIAFFCWRSSGFSDRGQLVPIVIQINPADGKQSQLITPFDDPLTWFHAKLCV

-continued

QIADANHHEMSSHLCRTHFVMEPFAIVTARQLAENHPLSLLLKPHFRFMLANNDLARKRLISRGGPVDELLAGTLQ

ESLQIVVNAYTEWSLDQFSLPTELKNRGMDDPDNLPHYPYRDDGLLLWNAIKKFVSEYLQIYYKTPQDLAEDLELQS

WVQELVSQSGGRVKGISDRINTLDQLVDIATAVIFTCGPQHAAVNYSQYEYMTFMPNMPLAAYKQMTSEGTIPD

RKSLLSFLPPSKQTADQLSILFILSAYRYDRLGYYDDKFLDPEAQDVLAKFQQELNEAEREIELNNKSRLINYNYLKPRL

VTNSISV

Codon-optimized coding sequence for WP_027843955.1

SEQ ID NO: 37

ATGAAGCCGTACCTGCCGCAGAACGACCCGAACCCGGAGAAGCGTAAAGATTGGCTGAACAAAAACCGTGA

GGAATACCAATTCAACTTTAACTATCTGAGCCCGCTGCCGCTGATCGACGATGTTCCGAACAACGAGGCGTTT

AGCCCGAAGTACCTGGCGGAACGTCTGCCGCTGACCTTCGGTAAACTGAGCGCGAACACCCTGGGCATTCGT

CTGCGTAGCTTTTGGGACCCGTTCGATGAGTTTCAGGACTATGAAGATTTCTTTCCGGTGCTGCCGACCCCGG

AACTGCTGAAGACCTACCAGAACGACGAGTATTTCGCGGAACAACGTCTGAGCGGTGTGAACCCGATGGTTA

TCCGTAGCATTAAAGAGCTGCCGCCGCACTTCGCGTTTAGCATCCGTGACCTGCAGGCGGAATTCGGCACCAG

CCTGAACCTGGAGCAAGAACTGAACAACGGCAACCTGTACATTGCGGATTATACCAGCCTGAGCTTTGTTCGT

GGTGGCAGCTACCTGCGTGGTCGTAAGAGCCTGCCGGCGCCGATTGCGCTGTTCTGCTGGCGTAACAGCGGT

TATTGCGATCGTGGCGAGCTGACCCCGATCGCGATTCAACTGGTGCCGGAACTGGGCACCGGTAGCCGTATTC

TGACCCCGTTTGACAGCCACCTGAACTGGCTGTACGCGAAAATCTGCATGCAAATTGCGGATGCGAACCACCA

CGAGATGAGCAGCCACCTGTGCCACACCCACCTGGTTATGGAGCCGTTTGCGGTGGTTACCGCGCGTCAGCTG

GCGGAAAACCACCCGCTGGGTCTGCTGCTGCGTCCGCACTTCCGTTTTATGCTGCACAACAACGAGCTGGCGC

GTAAGAACCTGATCAACCAGGGTGGCTACGTTGACAACCTGCTGGGTGGCACCCTGCGTGAAAGCCTGCAAA

TTGTGCGTGACGCGTATTTCAAGAACGCGGAGGAATTTTGGAGCCTGGATGAGTTCGCGCTGCCGAAAGAAA

TCGCGAACCGTGGTCTGGACGATACCGATCGTCTGCCGCACTACCCGTATCGTGACGATGGCATGCTGCTGTG

GAACGCGATTGAAAAGTTTGTTAGCAACTACCTGAGCATCTACTATCCGAACCCGGGTGACATTAAAGATGAT

CGTGAGCTGCAAGCGTGGGCGGCGGAACTGGTGGCGGCGGATGGTGGCCGTGTGAAGGGCGTTCCGAGCC

AATTTGAGAACCTGCAGCAACTGATCGACGTGGTTACCGGTATCATTTTTACCTGCGGTCCGCAGCACAGCGC

GGTGAACTACCCGCAATACGAATATATGGCGTTTGTTCCGAACATGCCGCTGGCGGGTTATCAGGCGGTGGA

CAGCAACCCGAACATGGATCTGAAAAGCCTGATGGCGTTCCTGCCGCCGCCGAACCAAACCGCGGACCAGCT

GCAAATCATTTACGGTCTGAGCGCGTACCGTTATGATCGTCTGGGCTACTATGACCGTGAGTTTAGCGATCCG

CACGCGGAGGAAGTGGTTCGTCTGTTCCAGCAAGACCTGAACCAGGTGGAGCGTAAGATCGAACTGCGTAAC

AAAAACCGTCTGGTGGAATATAACTTCCTGAAACCGAGCCTGGTTCTGAACAGCATCAGCATTTAA

Amino acid Sequence for WP_027843955.1

SEQ ID NO: 38

MKPYLPQNDPNPEKRKDWLNKNREEYQFNFNYLSPLPLIDDVPNNEAFSPKYLAERLPLTFGKLSANTLGIRLRSFW

DPFDEFQDYEDFFPVLPTPELLKTYQNDEYFAEQRLSGVNPMVIRSIKELPPHFAFSIRDLQAEFGTSLNLEQELNNG

NLYIADYTSLSFVRGGSYLRGRKSLPAPIALFCWRNSGYCDRGELTPIAIQLVPELGTGSRILTPFDSHLNWLYAKICM

QIADANHHEMSSHLCHTHLVMEPFAVVTARQLAENHPLGLLLRPHFRFMLHNNELARKNLINQGGYVDNLLGGT

LRESLQIVRDAYFKNAEEFWSLDEFALPKEIANRGLDDTDRLPHYPYRDDGMLLWNAIEKFVSNYLSIYYPNPGDIK

DDRELQAWAAELVAADGGRVKGVPSQFENLQQLIDVVTGIIFTCGPQHSAVNYPQYEYMAFVPNMPLAGYQAV

DSNPNMDLKSLMAFLPPPNQTADQLQIIYGLSAYRYDRLGYYDREFSDPHAEEVVRLFQQDLNQVERKIELRNKNR

LVEYNFLKPSLVLNSISI

-continued

Codon-optimized coding sequence for WP_073641301.1

SEQ ID NO: 39

ATGAAACCGTACCTGCCGCAGAACGACCCGGATCCGATTAAGCGTAAATACAGCCTGGAGCACAAGAAAGAG

GAATATGAATTCGACCACGATTTTCTGAGCCCGATGGCGATGCTGAAAGACGTGCCGGCGGTTGAGAACTTC

AGCACCCGTTATATTGCGGAACGTACCGTGGAGACCGCGGAACTGCCGATCAACATGCTGGCGGTTAAGACC

CGTGCGCTGTGGGACCCGCTGGATGAGCTGCAGGACTACGAAGATTATTTCCCGGTGCTGCCGAAGCCGAAC

GTTATCAAAACCTACCAGACCGACGATAGCTTTTGCGAGCAACGTCTGTGCGGTGCGAACCCGATGGCGCTGC

AGCAAATCAAAGAGATGCCGCTGGGCTTCGAATTTACCATTGAGGAACTGCAGGAGAAATTCGGTGAAAGCA

TCAACCTGGTGGAGAAGCTGGCGGACGGCAACCTGTACGTGACCGATTATCGTCCGCTGAGCTTTGTTAAGG

GTGGCACCTACGAACGTGGTAAGAAATATCTGCCGACCCCGCTGGCGTTCTTTTGCTGGCGTAGCAGCGGTTT

TAGCGACCGTGGTCAGCTGGTGCCGATCGCGATTCAACTGAACCCGGCGGTTGGCCGTCAGAGCCAACTGAT

TACCCCGTTCGACGATCCGCTGACCTGGTTTCACGCGAAACTGTGCGTTCAGATCGCGGACGCGAACCACCAC

GAGATGAGCAGCCACCTGTGCCGTACCCACTTCGTGATGGAACCGTTTGCGATTGTTACCGCGCGTCAACTGG

CGGATAACCACCCGCTGAACCTGCTGCTGAAACCGCACTTCCGTTTTATGCTGGCGAACAACGACCTGGGTCG

TAAGCGTCTGGTGAACCGTGGTGGCCCGGTTGATGAGCTGCTGGCGGGCACCCTGCAGGAAAGCCTGCAAAT

TGTGGTTAACGCGTACAAAGAGTGGAGCCTGGATGAATTCGCGCTGCCGACCGAAATCAAGAACCGTGGTAT

GGACGATAAGCTGAAACTGCCGCACTACCCGTATCGTGACGATGGCATGCTGCTGTGGAACGCGATTAAGAA

ATTTGTGAGCGAGTACCTGAAGCTGTACTATAAAACCCCGCAGGACCTGACCGCGGATCTGGAACTGCAGGC

GTGGGCGCAAGAGCTGGTTAGCGAAAGCGGTGGCCGTGTGAAAGGTGTTCCGAGCCGTATCGAGAAGCTGG

AACAACTGGTGGACATCGCGACCGCGGTTATTTTTACCTGCGGTCCGCAGCATGCGGCGGTGAACTACAGCCA

ATACGAGTATATGACCTTTATGCCGAACATGCCGCTGGCGGCGTATAAGCAGATGACCGCGGAAGGCACCAT

CGCGGATCGTAAAAGCCTGCTGAGCTTCCTGCCGCCGAGCAAGCAGACCGCGGACCAACTGAGCATCCTGTTT

ATTCTGAGCGCGTACCGTTATGATCGTCTGGGTTACTATGACGATAAATTCGCGGACCCGGAGGCGCAAGATA

TTCTGGTGACCTTTCAGCAAGACCTGAACGAGGTTGAGCGTAAGATCGAACTGAACAACAAGAGCCGTCTGA

TTAAATACAACTATCTGAAGCCGCGTCTGGTGACCAACAGCATCAGCGTTTAA

Amino acid Sequence for WP_073641301.1

SEQ ID NO: 40

MKPYLPQNDPDPIKRKYSLEHKKEEYEFDHDFLSPMAMLKDVPAVENFSTRYIAERTVETAELPINMLAVKTRALW

DPLDELQDYEDYFPVLPKPNVIKTYQTDDSFCEQRLCGANPMALQQIKEMPLGFEFTIEELQEKFGESINLVEKLAD

GNLYVTDYRPLSFVKGGTYERGKKYLPTPLAFFCWRSSGFSDRGQLVPIAIQLNPAVGRQSQLITPFDDPLTWFHAK

LCVQIADANHHEMSSHLCRTHFVMEPFAIVTARQLADNHPLNLLLKPHFRFMLANNDLGRKRLVNRGGPVDELA

GTLQESLQIVVNAYKEWSLDEFALPTEIKNRGMDDKLKLPHYPYRDDGMLLWNAIKKFVSEYLKLYYKTPQDLTADL

ELQAWAQELVSESGGRVKGVPSRIEKLEQLVDIATAVIFTCGPQHAAVNYSQYEYMTFMPNMPLAAYKQMTAEG

TIADRKSLLSFLPPSKQTADQLSILFILSAYRYDRLGYYDDKFADPEAQDILVTFQQDLNEVERKIELNNKSRLIKYNYLK

PRLVTNSISV

Codon-optimized coding sequence for WP_096647440.1

SEQ ID NO: 41

ATGAAACCGTACCTGCCGCAGAACGACCCGGAGCCGACCCAGCGTAAGAACTTCCTGGAACGTAAACAGGGC

GAGTATGAATTCGATCACAAGTTTCTGAAACCGATGGCGATGCTGAAGAACGTGCCGAGCATTGAGAACTTTA

GCACCAAATACATCGCGGAACGTACCGTGGAGACCGCGGAACTGCCGCTGAACATGCTGGCGGTTAAAACCC

GTAGCCTGTGGGACCCGCTGGATGAGCTGCAGGACTACGAAGATTATTTCCCGGTGCTGCCGAAGCCGAACG

TTATCAAAACCTACCAGACCGACAACAGCTTTTGCGAGCAACGTCTGTGCGGTGCGAACCCGCTGGTTCTGCG

TCAGATTCAGCAAATGCCGGATGGCTTCGCGTTTACCATCAGCGAGCTGCAAGAAAAGTTCGGTGACAGCATT

-continued

GATCTGGAGGAACGTCTGAAAACCGGCAACCTGTACGTGGCGGACTATCGTGCGCTGGCGTTTGTTAAGGGT

GGCACCTACGAGCGTGGTAAGAAATATCTGCCGACCCCGATCGCGTTCTTTTGCTGGCGTAGCAGCGGTTTCA

GCGATCGTGGCCAGCTGGTGCCGATCGCGATTCAAATCAACCCGACCGACGGCAAGCAGAGCCAACTGATCA

CCCCGTTCGATGAACCGCTGGTGTGGTTTCACGCGAAACTGTGCGTTCAGATTGCGGACGCGAACCACCACGA

GATGAGCAGCCACCTGTGCCGTACCCACTTCGTGATGGAACCGTTTGCGATTGTTACCGCGCGTCAGCTGGCG

GATAACCACCCGCTGAACCTGCTGCTGAAGCCGCACTTCCGTTTTATGCTGGCGAACAACGAGCTGGGTCGTC

AACGTCTGGTGAACCGTGGTGGCCCGGTTGATGAGCTGCTGGCGGGCACCCTGCAGGAAAGCCTGCAAATCG

TGGTTAACGCGTACAAAGAGTGGAGCCTGGATCAGTTCAGCCTGCCGACCGAACTGAAGAACCGTGGTATGG

ACAACAGCGATAAACTGCCGCACTACCCGTATCGTGACGATGGCCTGCTGCTGTGGAACGCGATTAAGAAATT

CGTGAGCGAATATCTGAAGCTGTACTATAAAACCCCGCAAGACCTGACCGCGGATTTTGAGCTGCAGAGCTG

GGCGCAAGAACTGGTTAGCCAGAGCGGTGGCCGTGTGAAAGGTGTTAGCGACCGTATCACCACCCTGGACCA

ACTGATTGATATCGCGACCGCGGTGATTTTTACCTGCGGTCCGCAGCATGCGGCGGTTAACTACAGCCAATAC

GAGTATATGACCTTTATCCCGAACATGCCGCTGGCGGCGTATAAGCAGATTACCAGCGAGGGTAACATCCCG

GACCGTAAGAGCCTGCTGAGCTTCCTGCCGCCGAGCAAACAGACCGCGGATCAACTGAGCATTCTGTTTATCC

TGAGCGCGTACCGTTATGACCGTCTGGGCTACTATGACGATAAATTCCTGGATCCGGAGGCGCAGGAAATCCT

GGTTACCTTTCAGCAAGAGCTGAACGAGGCGGAACGTCAAATTGAACTGAACAACAAGAGCCGTCTGATCAA

CTACGACTATCTGAAACCGCGTCTGGTGACCAACAGCATTAGCGTTTAA

Amino acid Sequence for WP_096647440.1

SEQ ID NO: 42

MKPYLPQNDPEPTQRKNFLERKQGEYEFDHKFLKPMAMLKNVPSIENFSTKYIAERTVETAELPLNMLAVKTRSLW

DPLDELQDYEDYFPVLPKPNVIKTYQTDNSFCEQRLCGANPLVLRQIQQMPDGFAFTISELQEKFGDSIDLEERLKTG

NLYVADYRALAFVKGGTYERGKKYLPTPIAFFCWRSSGFSDRGQLVPIAIQINPTDGKQSQLITPFDEPLVWFHAKLC

VQIADANHHEMSSHLCRTHFVMEPFAIVTARQLADNHPLNLLLKPHFRFMLANNELGRQRLVNRGGPVDELLAG

TLQESLQIVVNAYKEWSLDQFSLPTELKNRGMDNSDKLPHYPYRDDGLLLWNAIKKFVSEYLKLYYKTPQDLTADFE

LQSWAQELVSQSGGRVKGVSDRITTLDQLIDIATAVIFTCGPQHAAVNYSQYEYMTFIPNMPLAAYKQITSEGNIPD

RKSLLSFLPPSKQTADQLSILFILSAYRYDRLGYYDDKFLDPEAQEILVTFQQELNEAERQIELNNKSRLINYDYLKPRLV

TNSISV

Codon-optimized coding sequence for WP_099099431.1

SEQ ID NO: 43

ATGAAACCGTACCTGCCGCAGAAAGACCCGGATGTTAAAGTGCGTATCAACTGGCTGGACAAAAACCGTGAG

GAATATAAGTTCAACTACGACTATCTGGCGCCGCTGCCGGTTATCGATAAAGTGCCGCACAAGGAGATTTTTA

GCGCGGAATACACCACCAAACGTCTGGCGAGCATGGCGAGCCTGGCGCCGAACATGCTGGCGGCGAAGGCG

CGTAACTTCCTGGACCCGCTGGATGAGCTGGAGGAATACGAGGAACTGCTGAGCCTGCTGCCGAAGCCGGAC

GTTATCAAGAACTATAAAACCGATAGCTGCTTTGCGGAACAACGTCTGAGCGGTGCGAACCCGCTGGCGATCC

AAAAAATTGACGTTCTGCCGGATAACTTCGCGGTGACCGATGCGCACTTTCAGAAGGTGGCGGGCACCGAGT

TCACCCTGGAAAAGGCGCTGAAAGAGGGCAAGCTGTACTTTCTGGACTATCCGCTGCTGAGCGATATCAAAG

GTGGCGTTTACAACAACGTGAAGAAATATCTGCCGAAGCCGCAGGCGCTGTTCTACTGGCAAAGCAACGACA

GCCCGAACGGTGGCAGCCTGGTTCCGGTGGCGATCCAGATTAACCACGATAGCGGTGGCAAAAGCGTTATCT

ATACCCCGGACGATCCGCACCTGGACTGGTTTCTGGCGAAGACCTGCGTGCAGATTGCGGATGGTAACCACC

AAGAGCTGGGCAGCCACTTCGCGTACACCCACGCGGTTATGGCGCCGTTTGCGATCGTGACCGCGCGTCAACT

GGCGGAAAACCACCCGATTGCGCTGCTGCTGAAACCGCACTTCCGTTTTATGCTGTTCGACAACGATCTGGGT

CGTACCCAGTTTCTGCAACCGGGTGGCCCGGTTGACGAGTTCATGGCGGGTAGCCTGGCGGAAAGCCTGGGC

TTTGTTGCGAAGGTGTACGAGGAATGGAGCGTGGAGAAATTCACCTTTCCGCGTCTGATCAAGAGCCGTCGT

-continued

ACCGACGATCCGGAAATTCTGCCGCACTTCCCGTTTCGTGACGATGGTATGCTGATCTGGAACGCGGTTGAGA

AATTCGTGTACGAATATCTGCAGCTGTACTATAAGACCAGCCAAGACCTGATTGACGATTATGAGCTGCAGAA

CTGGGCGCGTGAACTGGTTGCGCAAGATGGTGGCCGTGTGAAAGGCATGCCGGCGAAGATCGAGACCCTGG

AACAGCTGATTGAGATCATTAGCGTGGTTGTTTTTACCTGCGCGCCGCTGCACAGCGCGCTGAACTTCAGCCA

ATACGAATATATGGCGTTTGTTCCGAACATGCCGTACGCGGCGTATCACCCGATCCCGGAGACCAAAGGTGTG

GACCTGGAAACCATCATGAAAATTCTGCCGCCGTTCAAGCAGGCGGCGGACCAAGTTATGTGGACCGAGATT

CTGACCAGCTACCACTATGATAAGCTGGGCTTCTACGACGAGGAATTTGCGGATCCGCTGGCGCAGGAAATC

GTTGTGCAATTCCAGCAAAACCTGCACGAGATTGAACGTCAGATCGATATTCGTAACCAAACCCGTCCGATCC

CGTACAACTATTTTAAACCGAGCCAGATCATTAACAGCATTAACACCTAA

Amino acid Sequence for WP_099099431.1

SEQ ID NO: 44

MKPYLPQKDPDVKVRINWLDKNREEYKFNYDYLAPLPVIDKVPHKEIFSAEYTTKRLASMASLAPNMLAAKARNFL

DPLDELEEYEELLSLLPKPDVIKNYKTDSCFAEQRLSGANPLAIQKIDVLPDNFAVTDAHFQKVAGTEFTLEKALKEGK

LYFLDYPLLSDIKGGVYNNVKKYLPKPQALFYWQSNDSPNGGSLVPVAIQINHDSGGKSVIYTPDDPHLDWFLAKTC

VQIADGNHQELGSHFAYTHAVMAPFAIVTARQLAENHPIALLLKPHFRFMLFDNDLGRTQFLQPGGPVDEFMAG

SLAESLGFVAKVYEEWSVEKFTFPRLIKSRRTDDPEILPHFPFRDDGMLIWNAVEKFVYEYLQLYYKTSQDLIDDYEL

QNWARELVAQDGGRVKGMPAKIETLEQLIEIISVVVFTCAPLHSALNFSQYEYMAFVPNMPYAAYHPIPETKGVDL

ETIMKILPPFKQAADQVMWTEILTSYHYDKLGFYDEEFADPLAQEIVVQFQQNLHEIERQIDIRNQTRPIPYNYFKPS

QIINSINT

Codon-optimized coding sequence for WP_052672367.1

SEQ ID NO: 45

ATGAAACCGTACCTGCCGCAACATGAGCCGGATGCGATTGCGCGTCAGAACCGTCTGATTAAAAACCGTGCG

GACTATGTGCTGGATTACAACTATCTGCCGCCGATCCCGCTGCAGACCCCGGTTCCGCAGCAAGAGCGTTTCA

GCGCGGAATACACCGCGCGTCGTCTGGCGAGCTTTGCGAACCTGGTGCCGAACATGCTGATGGCGCGTGCGC

GTAACGCGTTTGACCCGCTGGATACCCTGGAGGAATATGCGGACCTGCTGCCGGTGCTGCCGAAGCCGAACG

TTATTAAAAACTATCAAGCGGATTGGTGCTTCGCGGAGCAGCGTCTGAGCGGTATCAACCCGCCGGCGATCCG

TCGTATTGACGCGCTGCCGGAAAACCTGCCGATTAGCAACAGCAGCTTTCAACACAGCGTTGGCGCGGAGCA

CAACCTGGAACAGGCGCTGAAGGAAGGTAAACTGTACTGCCTGGACTATCCGCTGCTGAGCGGCATCGGTGG

CGGTAACTACCAAAACCTGCCGAAGTATCTGCCGAAACCGCAGGCGCTGTTTTACTGGCGTAGCGATAACAGC

AAGATTGGCGGTAGCCTGGTGCCGGTTGCGATCAAGATTCTGAACGAGCTGGGCGGTAAAAACCTGGTGTAC

1ACCCCGAACGACGCGCCGCTGGATTGGTTCCTGGCGAAGACCTGCGTTCAGATGGCGGACGCGAACCACCAA

GAACTGGGCACCCACTTTGCGAAAACCCATGCGGTTATGGCGCCGATTGCGGCGATTACCGCGCGTGAGCTG

GGTGAAAACCACCCGCTGACCCTGCTGCTGAAACCGCACTTCCGTTTTATGCTGTTCGATAACGAGCTGGGTC

GTACCCAGTTTCTGCAACCGACCGGTCCGACCGAGGAACTGCTGGCGGGCACCCTGGAGGAAAGCGTTCAGC

TGGTTGTGCAAGCGTACGAGGAATGGAGCATCGACACCACCTTCCCGCTGGAGCTGCAGCAACGTCAAATGC

ACGATCCGGAAATTCTGCCGCACTATCCGTTCCGTGACGATGGCATCCTGGTGTGGAACGCGATTCACCAGTT

TGTTACCGAATACCTGCAAATTTACTATCACACCCCGCAGGACATCAGCGCGGATTATGAGGTGCAGAACTGG

GCGCGTGAACTGGTGGACAGCGGTCGTGTTAAGGGTATGCCGGAGAGCATCGACACCCTGGCGCAACTGATT

GATATCATTGCGGTGGTTATCTTCACCTGCGCGCCGCTGCACAGCTGCCTGAACCTGGCGCAGTACGAATATA

TGACCTTTGTTCCGAACATGCCGTACGCGGCGTATCACCCGATCCCGACCACCAAGGGTGTGGATATGGCGAC

CATCGTTAAAATTATGCCGCCATTCCAGCGTGCGATCGACCAAATTCTGTGGACCGATATCCTGAGCGCGTTTC

AATACGACAAGCTGGGCTTCTATGAGGAAGACTTTGCGGATCCGAAAGCGCAGGAAGTGCTGCAGCGTTTCC

-continued

AAGATAACCTGCAGCAAGTTGAGGAAAAGATCGAAATGCACAACCAGATCCGTCCGATTCCGTACAACTATCT

GAAACCGAGCCGTATCATGAACAGCATTAACACCTAA

Amino acid Sequence for WP_052672367.1

SEQ ID NO: 46

MKPYLPQHEPDAIARQNRLIKNRADYVLDYNYLPPIPLQTPVPQQERFSAEYTARRLASFANLVPNMLMARARNA

FDPLDTLEEYADLLPVLPKPNVIKNYQADWCFAEQRLSGINPPAIRRIDALPENLPISNSSFQHSVGAEHNLEQALKE

GKLYCLDYPLLSGIGGGNYQNLPKYLPKPQALFYWRSDNSKIGGSLVPVAIKILNELGGKNLVYTPNDAPLDWFLAK

TCVQMADANHQELGTHFAKTHAVMAPIAAITARELGENHPLTLLLKPHFRFMLFDNELGRTQFLQPTGPTEELLA

GTLEESVQLVVQAYEEWSIDTTFPLELQQRQMHDPEILPHYPFRDDGILVWNAIHQFVTEYLQIYYHTPQDISADYE

VQNWARELVDSGRVKGMPESIDTLAQLIDIIAVVIFTCAPLHSCLNLAQYEYMTFVPNMPYAAYHPIPTTKGVDMA

TIVKIMPPFQRAIDQILWTDILSAFQYDKLGFYEEDFADPKAQEVLQRFQDNLQQVEEKIEMHNQIRPIPYNYLKPSR

IMNSINT

Codon-optimized coding sequence for WP_073631249.1

SEQ ID NO: 47

ATGAAACCGTACCTGCCGCAGCATGACCCGAACCCGGAAGCGCGTCGTAACTGGCTGGAACAAAACCGTGAG

GACTACAAGTTTGATCACAACTATCTGGCGCCGATCCCGATTCTGGACAAGGTTCCGCACAAAGAGCTGTTCA

GCCCGCAGTATACCGCGAAACGTCTGGCGAGCATGGCGGATCTGGTGCCGAACATGCTGGCGGCGAAGGCG

CGTAACTTCTTTGACCCGCTGGATGAACTGGAGGAATACGAGGCGCTGCTGAGCATTCTGCCGAAACCGAGC

GTTATCAAGAACTATAAAACCGACAGCTGCTTTGCGGAACAGCGTCTGAGCGGTGCGAACCCGATGGCGATG

CACCGTATTGACGAGCTGCCGGAAAAGTTCCCGGTTACCAACGATCACTTTCAAAAAGCGGTGGGTGCGGAA

CACAACCTGGAGGCGGCGCTGAAAGAGGGTAAACTGTACCTGCTGGACTATCCGCTGCTGTTTGATATTAAG

GGTGGCACCTACCAGAACATCAAGAAATATCTGCCGAAACCGCAGGCGCTGTTCTACTGGCAAAGCAACGGT

AACAAGAACAGCGGCAGCCTGGTTCCGATCGCGATTCAAATCCACAACGACACCGGTGGCGATAGCCTGATT

TATACCCCGGACGATCCGCACCTGGACTGGTTCCTGGCGAAGACCTGCGTGCAGATCGCGGATGCGAACCAC

CAAGAACTGGGTAGCCACTTCGCGCGTACCCACGCGGTTATGGCGCCGTTTGCGATTGTGACCGCGCGTCAAC

TGGGTGAAAACCACCCGCTGGCGCTGCTGCTGAAACCGCACTTCCGTTTTATGCTGTACGACAACGATCTGGG

TCGTACCCACTTCCTGCAGGCGGGTGGCCCGGTTGACGAATTTATGGCGGGCACCCTGCAAGAGAGCCTGGG

CTTTGTGGCGAAGGCGTACGAGGAATGGAGCCTGGATAACGCGGTTTTCCCGACCGAAGTGAAGAACCGTAA

AATGGACGATCCGGACATTCTGCCGCACTATCCGTTTCGTGACGATGGTATGCTGCTGTGGGATGCGGTTAAG

AAATTCGTGACCGAATACCTGCAGCTGTACTATAAAACCCCGCAAGACCTGAGCGAGGATTATGAACTGCAAA

ACTGGGCGCGTGAGCTGGCGGCGCAAGACGGTGGCTGCGTTAAGGGCATGCCGGAGAAAATTGAAACCATC

GAGCAGCTGATCCACGTGGTTACCGTGGTTGTGTTTACCTGCGCGCCGCTGCACAGCGCGCTGAACTTCAGCC

AATACGAATATATGGCGTTTGTTCCGAACATGCCGTACGCGGCGTACTATCCGGTTCCGGAGACCAAAGGTGT

GGATATGCAGACCATTATGAAGATGCTGCCGCCGTTCAAACAGGCGGCGGACCAAGTGATGTGGAGCGATAT

CCTGACCAGCTTCCACTACGACAAGCTGGGCCACTATGATGAGGAATTTGCGAACCCGATGGCGCAGGCGAT

CCTGCTGCAATTCCAGCAAAACCTGCACGAGGTGGAACGTCAGATTGAAATCAAGAACCAAAGCCGTCCGATT

CCGTACAACTATCTGAAACCGAGCGAGATCATTAACAGCATCAACACCTAA

Amino acid Sequence for WP_073631249.1

SEQ ID NO: 48

MKPYLPQHDPNPEARRNWLEQNREDYKFDHNYLAPIPILDKVPHKELFSPQYTAKRLASMADLVPNMLAAKARN

FFDPLDELEEYEALLSILPKPSVIKNYKTDSCFAEQRLSGANPMAMHRIDELPEKFPVTNDHFQKAVGAEHNLEAALK

EGKLYLLDYPLLFDIKGGTYQNIKKYLPKPQALFYWQSNGNKNSGSLVPIAIQIHNDTGGDSLIYTPDDPHLDWFLAK

TCVQIADANHQELGSHFARTHAVMAPFAIVTARQLGENHPLALLLKPHFRFMLYDNDLGRTHFLQAGGPVDEFM

AGTLQESLGFVAKAYEEWSLDNAVFPTEVKNRKMDDPDILPHYPFRDDGMLLWDAVKKFVTEYLQLYYKTPQDLS

-continued

EDYELQNWARELAAQDGGCVKGMPEKIETIEQLIHVVTVVVFTCAPLHSALNFSQYEYMAFVPNMPYAAYYPVPE

TKGVDMQTIMKMLPPFKQAADQVMWSDILTSFHYDKLGHYDEEFANPMAQAILLQFQQNLHEVERQIEIKNQS

RPIPYNYLKPSEIINSINT

Codon-optimized coding sequence for WP_013220336.1

SEQ ID NO: 49

ATGAACACCAGCCTGCCGCAGAACGACAGCGATCCGCAAGGTCGTAAGGACCGTCTGGAACGTCGTCGTGCG

CTGTACGTGTTCAACTACGACTATGTTCCGCCGATCCCGATGATTGATAAGGTTCCGCACGAGGAATACTTTAG

CCCGAAATATACCGCGGAGCGTCTGGCGAGCATGGCGAAACTGGCGCCGAACATGCTGGCGGCGAAGACCA

AACGTCTGTTCGATCCGCTGGACGAGCTGAACGAATACGACGAGATGTTCATCTTTCTGGATAAGCCGGGTAT

TGTTCGTGGCTATCGTACCGATGAAAGCTTCGGCGAGCAGCGTCTGAGCGGCGTGAACCCGATGAGCATCCG

TCGTCTGGATAAACTGCCGGAAGACTTTCCGATTATGGATGAATACCTGGAGCAGAGCCTGGGTAGCCCGCA

CACCCTGGCGCAGGCGCTGCAAGAAGGCCGTCTGTATTTCCTGGAGTTTCCGCAACTGGCGCACGTTAAAGA

GGGTGGTCTGTACCGTGGTCGTAAGAAATATCTGCCGAAACCGCGTGCGCTGTTCTGCTGGGACGGTAACCA

CCTGCAGCCGGTGGCGATCCAGATTAGCGGCCAACCGGGTGGCCGTCTGTTCATTCCGCGTGACAGCGATCT

GGACTGGTTTGTGGCGAAGCTGTGCGTTCAGATCGCGGATGCGAACCACCAAGAACTGGGCACCCACTTCGC

GCGTACCCACGTGGTTATGGCGCCGTTTGCGGTGGTTACCCATCGTCAGCTGGCGGAGAACCACCCGCTGCAC

ATTCTGCTGCGTCCGCACTTCCGTTTTATGCTGTACGATAACGACCTGGGTCGTACCCGTTTTATCCAGCCGGA

CGGCCCGGTTGAACACATGATGGCGGGCACCCTGGAGGAAAGCATCGGCATTAGCGCGGCGTTCTACAAGG

AATGGCGTCTGGATGAGGCGGCGTTTCCGATCGAGATTGCGCGTCGTAAAATGGACGATCCGGAAGTGCTGC

CGCACTACCCGTTCCGTGACGATGGTATGCTGCTGTGGGACGGCATTCAGAAGTTTGTTAAAGAGTATCTGGC

GCTGTACTATCAAAGCCCGGAAGATCTGGTGCAGGACCAAGAGCTGCGTAACTGGGCGCGTGAACTGACCGC

GAACGATGGTGGCCGTGTGGCGGGTATGCCGGGTCGTATCGAAACCGTTGATCAGCTGACCAGCATCCTGAG

CACCGTGATTTATACCTGCGCGCCGCTGCACAGCGCGCTGAACTTCGCGCAATACGAGTATATCGGTTATGTTC

CGAACATGCCGTACGCGGCGTATCACCCGATTCCGGAGGAAGGTGGCGTGGACATGGAGACCCTGATGAAG

ATTCTGCCGCCGTACGAACAGGCGGCGCTGCAACTGAAATGGACCGAGATCCTGACCAGCTACCACTATGATC

GTCTGGGCCACTATGACGAAAAGTTCGAGGATCCGCAGGCGCAAGCGGTGGTTGAACAGTTTCAGCAAGAGC

TGGCGGCGGTGGAGCAAGAAATTGACCAGCGTAACCAAGATCGTCCGCTGGCGTACACCTATCTGAAACCGA

GCGAAATCATTAACAGCATCAACACCTAA

Amino acid Sequence for WP_013220336.1

SEQ ID NO: 50

MNTSLPQNDSDPQGRKDRLERRRALYVFNYDYVPPIPMIDKVPHEEYFSPKYTAERLASMAKLAPNMLAAKTKRLF

DPLDELNEYDEMFIFLDKPGIVRGYRTDESFGEQRLSGVNPMSIRRLDKLPEDFPIMDEYLEQSLGSPHTLAQALQE

GRLYFLEFPQLAHVKEGGLYRGRKKYLPKPRALFCWDGNHLQPVAIQISGQPGGRLFIPRDSDLDWFVAKLCVQIA

DANHQELGTHFARTHVVMAPFAVVTHRQLAENHPLHILLRPHFRFMLYDNDLGRTRFIQPDGPVEHMMAGTLEE

SIGISAAFYKEWRLDEAAFPIEIARRKMDDPEVLPHYPFRDDGMLLWDGIQKFVKEYLALYYQSPEDLVQDQELRN

WARELTANDGGRVAGMPGRIETVDQLTSILSTVIYTCAPLHSALNFAQYEYIGYVPNMPYAAYHPIPEEGGVDMET

LMKILPPYEQAALQLKWTEILTSYHYDRLGHYDEKFEDPQAQAVVEQFQQELAAVEQEIDQRNQDRPLAYTYLKPS

EIINSINT

4. Consensus Sequences
Consensus sequence of CoLox

SEQ ID NO: 51

MxSxPTVRSMVMLAVLAVxALESxPCASAFATLPRALVRPQAALKYRAEDKNDVDVAPAGSTASDVSKP

EGKATAVAKGTVNAPIEEAWKVFRSFSNMxQWMPVYGEWEATGDSVGDTRTFNFKDQPTFFTTERLV

GLDDSQYKMKYTLVxCKGSPVPIESIDTIVTFTANDDVTEVDWRSWTKSPMVDLIKGRQAAGYAGGIAA

-continued

LDRYLNPSLGTVDVTIKSADNLDGxFLSSSYATLMVTDADPEQVHAKEWGTSPEFDAKPVQFSLLKPDSK

LYMxVMLTKxGVDxPVGYAVFDIQKSLKSGETVTETFQLEGSNDATLTVEMELNLRQGSxLPQSKAQKNL

ATLVALQQSVERVRDRIVTIGKLAGEPEKSVWEYERKSGLPKSVKGLPRSEVLPPHKIALMVDAIAEYAYT

QFQLVQRLLPVRNSYDRYAAYFAPEGEEYVPIPQILKDMTWSTDDEFIRQIFAGLNPLQVEVVKNKAGLP

SKLQELKAxDGSDVDKLISEGRLYVLDYSVLKDLDLxRNGVTLYAPTMLIYRTGGDKLDVLGIMLEPRRDD

APVYTPDSETPNKFLLAKCHVACADNQVHQFTYHLGYAHLATEPLAIASHNVLEKNSHPLGMFLKPHxR

DNIGINYLARQTLVADEDAITDHTFATGTAQGVSMVVDAFKSYNFLESGLPDELRRRGFERSDDLKVYRY

RDDGWLxWDTLWKYAEDMVNELYGTDNDVxADKVVQEWAxEASGSDTADVQGFPESITTKYILTKVL

TTIIWQASALHSALNYIQYPYTATPINRAASIFGPVPDGEADITEQDILDVIPGGLxDENNRGLTLSIFQGLL

SWLLRTPENPTLDEVGSPIPNRNNPIEWVEFRSKYPQVYYNLDQNLAVVEKIIEERNKGLASPYEVLLPSHI

AASINI

Consensus sequence for the protein sequences of bacterial LOX

SEQ ID NO: 52 xxxxxxxxxxLPQxxxxxxxRxxxLxxxxxxYxxxxxxxxxPxxxxxxxPxxExFSxxYxxxRxxxxxxxLxxNxxxxxxxxxx DPxDxxxxYxxxxxxxxxPxxxxxYxxxxxFxEQRLxGxNPxxxxxxxxxxxxxxxxxxxxxxxxxxxxxxxxxxLxxxxxY xxxxxxxxxxxxxxxxxxGGxxxxxxKxLPxPxAxFxWxxxxxxxxxxxxPxxlxxxxxxxxxxxxxxxxxxxxPxxxxxxx WxxAKxCxQxADxNHxExxxHxxxTHxVMxPxAxxTxxxLxxNHPxxxLLxPHxxFMLxxNxLxxxxxxxxxGxx xxxxxGxLxExxxxxxxxxxxxxxxxWxxxxxxxPxxxxxRxxxxxxxLPHxPxRDDGxLxWxxxxxFVxxYxxxxYxxx xxxxxDxExxxWxxELxxxxxxxxxGxVxGxxxxxxxxxxLxxxxxxxxxxCxPxHxxxNxxQxxYxxxxxNMPxAxYx xxxxxxxxxxxxxxxxxxxxxxxxxxxxxxxxxxxxxxxxxxxxxxxxxxxxxxxxxxxxxxxxxxxxxxxxxxxxPxxxxxxxQ xxxxxxLxxxxYDxLGxYxxxxxxxxxxxFxxxxxxxxxxxxxxxxxFQxxLxxxxxxlxxxNxxRxxxYxxxxPxxxxNSIx x xxx = amino acids that are locate in a key long helix close to the reaction center
xxx = amino acids that are locate in a key shorter helix close to the reaction center
xxx = amino acids that are locate in a key long helix close to the reaction center
Five essential conserved amino acid residues of the active site which are assumed to be involved in the binding of cofactors are shown in enlarged bold letters.

Consensus sequence for bacterial LOX and UfLOX2 protein sequences

SEQ ID NO: 53 xxxxxxxxxxLPxxxxxxxxRxxxxxxxxxxxxxxxxxxxxxxxxxxxPxxxxxxSxxYxxxRxxxxxxxxxxNxxxxxxxxxx DxxxxxxxxxxxxxxxxxxxPxxxxxxxxxxxxFxEQRLxGxNPxxxxxxxxxxxxxxxxxxxxxxxxxxxxxxxxxxxLxxxx xYxxxxxxxxxxxxxxxxxxxGxxxxxxKxLPxPxxxFxWxxxxxxxxxxxxxPxxIxxxxxxxxxxxxxxxxxxxxPxxxxx xxWxxAKxCxQxADxxHxExxxHxxxxxHxxMxPxAxxxxxxxxxxxHPxxxaxxHxxFxxxxxxxxxxxxxxxxxGxxx xxxxGxLxExxxxxxxxxxxxxxxxWxxxxxxxxxxxxxRxxxxxxxLPHxPxRDDGxLxWxxxxxxVxxYxxxxYxxxxx xxxDxExxxxxxExxxxxxxxxxGxVxGxxxxxxxxxxLxxxxxxxxxxCxPxHxxxNxxQxxYxxxxxxNMPxAxYxxxxx xxxxxxxxxxxxxxxxxxxxxxxxxxxxxxxxxxxxxxxxxxxxxxxxxxxxxxxxxxxxxxxxxxxxxxxxxxPxxxxxxxQxxx xxxLxxxxxDxxGxYxxxxxxxxxxxFxxxxxxxxxxxxxxxxxxxxQxxLxxxxxxIxxxNxxRxxxYxxxxxxxxxxNSIxx xxx = amino acids that locate in a key long helix close to the reaction center
xxx = amino acids that locate in a key shorter helix close to the reaction center
xxx = amino acids that locate in a key long helix close to the reaction center
Five essential conserved amino acid residues of the active site which are assumed to be involved in the binding of cofactors are shown in enlarged bold letters.

Consensus sequence for bacterial LOX, CoLOXs and UfLOX2 protein sequences

SEQ ID NO: 54 xxxxxxxxxxxxxxxxxxxxxxxxxxxxxxxxxxxxxxxxxxxxxxxxxxxxxxxxxxxxxxxxxxxxxxxxxxxxxxxxxxxxxx xxxxxxxxxxxxxxxxxxxxxxxxxxxxxxxxxxxxxxxxxxxxxxxxxxxxxxxxxxxxxxxxxxxxxxxxxxxxxxxxxxxxxx xxxxxxxxxxxxxxxxxxxxxxxxxxxxxxxxxxxxxxxxxxxxxxxxxxxxxxxxxxxxxxxxxxxxxxxxxxxxxxxxxxxxxx -continued xxxxxxxxxxxxxxxxxxxxxxxxxxxxxxxxxxxxxxxxxxxxxxxxxxxxxxxxxxxxxxxxxxxxxxxxxxxxxxxxxxxxxxxx xxxxxxxxxxxxxxxxxxxxxxxxxxxxxxxxxxExxxxxxxPxxxxxxxxxxxxxxxxxxxxxxxxxxxxxxxxxxxxxxLxxxxxx xxxYxxxxxxxxxxxxxxxxxxxxxxxxxxxxxxxxxxxxxxxxxxxxxxxxxxxxxxxxxxxxxxxxxxxxxxxxxxxxxxxxxxxx xxxxxxxxxxxxxxxxxxxxxxxxxxxxxxxxxxxxxxxxxxxxxxxPxxxxxxxxxxAKxxxxxADxxxxxxxxxHxxxxHxxx xPxAxxxxxxxxxxxHPxxxxLxxHxxxxxxxxxxxxxxxxxxxxxxxxxxxxxxxxxxxxxxxxxxxxxxxxxxxxxxxxxxxxx xxxRxxxxxxxLxxxxxRDDGxLxWxxxxxxxxxxxxxxxYxxxxxxxxDxxxxxxxxExxxxxxxxxxxxxVxGxxxxxxxxx xLxxxxxxxxxxxxxxHxxxNQxxYxxxxxNxxxxxxxxxxxxxxxxxxxxxxxxxxxxxxxxxxxxxxxxxxxxxxxxxxxx xxxxxxxxxxxxxxxxxxxxxxxxxxxxxxxxxxPxxxxxxxxxxxxxxxxxxLxxxxxxxxxxxxxxxxxxxxxxxxxxxxxxxxxx xxxxxxxxxxxxxLxxxxxxIxxxNxxxxxxYxxxxxxxxxxSIxx xxx = amino acids that locate in a key long helix close to the reaction center
xxx = amino acids that locate in a key long helix close to the reaction center
Five essential conserved amino acid residues of the active site which are assumed to be involved in the binding of cofactors are shown in enlarged bold letters.

5. Others
CoLOX forward primer (SEQ ID NO: 55)

(5'- CTCTCTCTCTTTCTCTCTGTTCT-3')

CoLOX reverse primer (SEQ ID NO: 56)

(5'- CTCGTTCCCTTACCGTCT-3')

UfLOX2 forward primer (SEQ ID NO: 57)

(5'-TCGTCCAACAGGTTCTCTT-3')

UfLOX2 reverse primer (SEQ ID NO: 58)

(5'- TTCTTTCCACTCACCGCCA-3').

6. Corresponding natural coding sequences for SEQ ID NO: 20, 22, 24, 26, 28, 30, 32, 34, 36, 38, 40, 42, 44, 46, 48, 50
Coding sequence for WP_002738122.1

SEQ ID NO: 59

ATGGTTAATACCCCTCCTCCCACTCCTTGTCTGCCCCAAAATGAACCAGATGCGAATCGGCGGGCTGATTCCCT

CAATCTTCAACGCCAAGCCTATAGATACGACTATCAGTATCTCCCACCCTTAGTCCTCATGGAATCCGTGCCTG

CAGCGGAAAACTTTTCCTTTCAGTACATTACTGAACGGTTGGCGGCAACTGCGGAACTACCGGCCAATATGCT

GGCTGTCAAAGTCAAATCTTTTTTAGATCCCCTCGATGAGCTACAAGATTATGAGGACTTCTTTGCCATTATCCC

CTTACCCAAAATCGCCAAAGTCTATCAAACCAATGATGCCTTTGCCGAACAACGTCTATCGGGAGCTAATCCCC

TAGTATTACATTTACTGAAGCCGGGGGATGCTCGCGCCCAAGTTCTCAATCAAATCCCTAGTTCTAAGACAGAT

TTCGAGCCATTGTTTCAGGTCAATCAAGAATTAGCAGCGGGAAACATTTATATTGCCGATTATACGGGTACGG

ACATTAATTATCTCGGTCCCTCTTTGATTCAAGGGGGAACCCATGCCAAAGGGCGAAAATATTTACCGAAACC

CAGGGCCTTCTTTTGGTGGCGGAAAAGTGGCATCAGAGATCGGGGCAAATTAGTTCCGATCGCTATCCAATTT

GGGGAAAATGCGGAAAAGCTTTATACTCCTTTTGAGAAAAACCCCCTTGCTTGGCTATTTGCTAAAATTTGTGT

TCAGGTGGCCGATAGCAATCACCACGAGATGAATTCCCATCTCTGTCGAACTCATTTTGTCATGGAACCGATCG

CGATCGGCACGGCCCGGCAACTGGCAGAAAATCATCCCCTCAGTCTTCTGCTTAAGCCACACCTAAGATTTAT

GTTAACGAACAACCATCTGGGACAAGAGAGACTGATCAACCCTGGTGGACCGGTGGATGAATTATTGGCCGG

CACCTTGGGCGAGTCGATGGCACTGGTTAAGGATGCCTACGCAAACTGGAATCTTCGAGACTTTGCCTTTCCC

AAAGAAATAAGTAACCGGGGTATGGACGATACGGAACGACTACCCCACTACCCTTACCGGGATGATGGGATG

CTGGTTTGGCAGTCTATTAATCAGTTTGTTTCTGATTATCTCCATTATTTTTACCCAAACCCCCAAGACATCACTA

ACGATCAAGAATTGCAAGCATGGGCCGGAGAATTATCTAATTCTGCGGCAGATCAAGGGGGCAATGTGAAG

GGAATGCCGGCCAATTTTACGGATGTAGAGGACTTAATTGAAGTCGTTACCACAATTATTTTTATCTGCGGGCC

-continued

ACTGCATTCAGCTGTTAACTATGGTCAGTATGATTACATGACTTTTGCCGCTAATATGCCCTTGGCCGCTTACTG

TGATCTTCCAGAAGCGATTAAGGATACTACAGGATCAATAATTGGAGATGCCAGAGGATCAATTACCGAAAA

AGACATTCTTCAGCTATTGCCTCCTTATAAAAAGGCTGCCGATCAGTTACAAAGTCTGTTCACTTTATCCGACTA

TCGATACGATCAATTGGGCTATTACGATAAAGCTTTTCGAGAACTCTATGGCCGGAAGTTTGAGGAGGTTTTT

GCCGAGGGTGATCAGGCAACAATTACGGGCTTCCTTCGACAATTTCAGCAAAATCTCAATATGAACGAACAAG

AGATTGATGCCAATAATCAAAAACGGATCGTACCCTATACCTATCTAAAACCTTCTCTAATACTCAATAGCATC

AGCATTTAA

Coding sequence for WP_006635899.1

SEQ ID NO: 60

ATGGTAGACAATATGAAACCTCTTCTTCCTCAAGACGACCCGAACCCAGAACAGCGCCACGATTCCTTGAATC

GTCAGCAACAAGCTTATCAGTTTGACTATGAGAGTTTATCACCTTTGGCATTATTGAAAGATGTGCCCGCAGTC

GAGAACTTTTCGAGTAAGTATCTTGCAGAACGCATATTAGCAACATCGGAACTTCCAGCAAATATGCTGGCAG

CCGATTCTAGAACTTTTCTCGATCCTCTCGACGAACTCCAAGACTATGAAGACTTTTTTACTTGGCTGCCGCTAC

CTGGAGTGGCCAAAATTTACCAAACCGATCGCTCTTTTGCAGAACAGCGCCTGTCTGGAGCAAATCCCATGGT

GCTTCGCCTGTTACATCAGGAGGACTCTCGGGCAGAAACACTGGCACAACTTTGCTGTTTGCAGCCATTATTCG

ATCTTCGCAAAGAGTTACAGGACAAAAACATTTACATTGCCGATTATACAGGTACTGACGAACACTATCGCGG

GCCTGCGAAAGTTGCAGGAGGAACCTATGAAAAAGGCAGAAAATACTTGCCGAAACCACGGGCTTTTTTCGC

TTGGCGGTGGACAGGAATCCGCGATCGCGGTGAAATGACACCTATTGCCATTCAACTAGATCCTAAGCCCGGT

AGCCATCTGTATACCCCATTCGATCCTCCTATCGATTGGCTGTATGCGAAACTCTGCGTACAAGTGGCAGATGC

TAATCACCATGAAATGAGTTCCCATTTAGGTCGAACTCATCTGGTGATGGAACCAATCGCGATCGTCACCGCCC

GACAGTTGGCTAAAAATCACCCGCTTAGCCTGCTGCTGAAACCGCACTTTCGCTTTATGTTGACCAACAACGAT

CTGGCGCGTTCTCACTTGATCGCTCCCGGCGGGCCCGTCGATGAATTGCTAGGCGGCACCTTGGCTGAGACAA

TGGAACTGACTAGAGAGGCGTGCAGTACATGGAGTCTCGATGAATTTGCCTTGCCCGCTGAACTGAAAAATC

GGGGAATGGATGACCCCAATCAACTGCCTCACTATCCTTACCGAGATGATGGATTGTTGCTTTGGGATGCGAT

TGAAACCTTTGTATCGGGCTATCTGAAATTCTTTTACCCGACGAATGAGGGGATCGTACAAGATGTGGAACTG

CAAACCTGGGCTAAAGAATTAGCGTCTGATGACGGCGGTAAAGTCAAAGGAATGCCACACCACATCGACACA

GTTGAACAATTAATTGCAATTGTCACAACTGTAATTTTTACCTGTGGTCCACAACATTCAGCAGTCAATTTTCCC

CAGTATGACTATATGAGTTTTGCGGCCAATATGCCCTTGGCAGCCTACCGGGACATTCCTGGAATTACCGCCTC

GGGTCATCTAGAAGTGATTACGGAAAATGACATTTTACGGTTGCTTCCTCCGTACAAACGAGCTGCTGACCAA

CTGCAAATTCTGTTTATTTTGTCAGCTTATCGATATGACCGTTTGGGTTATTACGATAAATCTTTCCGAGAACTC

TACCGGATGAGCTTCGATGAAGTTTTTGCGGGAACGCCGATCCAACTTTTAGCCAGACAGTTCCAGCAAAATT

TGAATATGGCAGAACAAAAGATTGATGCCAACAATCAAAAACGAGTCATCCCTTATTTTGCTCTCAAGCCTTCG

TTGGTACTAAATAGCATCAGTATGTAG

Coding sequence for WP_015178512.1

SEQ ID NO: 61

ATGGTAGACAATATGAAACCTTCTCTTCCTCAAGACGACCCGAACCAAGAACAGCGCAAAGATTCCTTGAATC

GCCAGCAACAAGCTTATCAGTTTGACTATGAGAGTTTATCACCTTTGGCATTATTGAAAAATGTGCCCGCAGTC

GAGAACTTTTCGAGCAAGTATATTGGAGAGCGGATATTAGCAACATCGGAACTTCCAGCAAATATGCTGGCA

GCCGATTCGAGAACTTTTCTCGATCCTCTCGACGAACTCCAAGACTATGAAGATTTCTTTACTCTGCTGCCGCTA

CCTGCTGTTGCCAAAATTTACCAAACCGATCGCTCTTTTGCAGAACAGCGCCTGTCTGGAGCAAATCCGATGGT

GCTTCGTTTGTTAGATGCCGGCGATCCTCGGGCGCAAACACTGGCACAAATTTCCAGCTTTCACCCATTATTCG

ATCTGGGCCAAGAGTTGCAGCAAAAAAACATTTACGTTGCCGATTACACGGGTACTGACGAACACTATCGCGC

GCCTTCAAAAATAGGAGGCGGAAGCTATGAAAAAGGCAGAAAATTCTTGCCGAAACCGCGGGCTTTTTTCGC

-continued

TTGGCGGTGGACGGGAATTCGCGATCGCGGTGAAATGACACCAATTGCCATTCAACTAGATCCCACGCCAGA

TAGCCATGTCTACACCCCATTCGATCCTCCTGTGGATTGGCTGTTTGCGAAACTCTGCGTGCAAGTAGCAGATG

CCAATCACCACGAAATGAGCTCGCATTTAGGTCGAACTCATCTGGTGATGGAACCAATTGCGATCGTCACCGC

CCGACAGTTGGCCCAAAATCACCCGCTGAGCCTGTTGCTGAAACCGCACTTTCGCTTTATGTTGACCAACAACG

AGCTGGCGCGTTCTTATTTGATCGCTCCCGGCGGGCCCGTCGATGAATTGCTAGGCGGTACTTTGCCAGAGAC

AATGGAAATAGCTAGAGAGGCTTGCAGTACCTGGAGTCTCGATGAATTTGCGTTGCCCGCCGAACTGAAAAA

TCGGGGAATGGATGACACAAATCAACTGCCTCACTACCCTTACCGAGATGATGGATTGCTGCTTTGGGATGCG

ATTGAAACCTTTGTATCCGGCTATCTGAAATTCTTTTACCCGACGGAGATCGCGATCGTACAAGATGTGGAACT

GCAAACCTGGGCCCAAGAATTAGCGTCCGATCGTGGCGGTAAAGTCAAAGGAATGCCTCCGCGCATCAACAC

AGTTGAACAATTAATTAAAATTGTCACAACTATAATTTTCACCTGCGGCCCGCAGCATTCAGCAGTCAATTTTCC

CCAGTATGAATACATGAGTTTTGCCGCCAATATGCCCTTGGCAGCCTACCGAGATATTCCCAAAATTACTGCTT

CGGGCAATCTCGAAGTGATTACTGAAAAGGACATTTTACGGTTGCTTCCTCCGTACAAGCGAGCGGCTGACCA

ACTGAAAATTCTGTTTACTTTGTCAGCTTATCGATATGACCGTTTGGGTTATTACGATAAATCTTTCCGAGAACT

CTACCGGATGAGTTTCGACGAAGTTTTTGCGGGAACCCCGATCCAACTTTTAGCCAGACAGTTCCAGCAAAAT

TTGAATATGGCAGAACAAAAGATTGATGCCAACAATCAAAAACGAGTAATTCCTTACATTGCTCTCAAGCCTTC

GTTGGTAATCAATAGCATCAGTATGTAG

Coding sequence for WP_015204462.1

SEQ ID NO: 62

ATGCCACAACCTTATCTTCCCCAAAACGAACCCAATCCAGAGAAGCGCAATAATGACTTGAGCGATCAGCAAC

AGGCTTATGAGTACGACTATAAGTATCTACCACCTTTGGTATTACTGAAAAAAATACCCGCATTCGAGAATTTC

TCGGCTCAATATATTGCGGAACGGGTAGTAGCAACCTCTGAACTGGTTCCAAATATGCTGGCAGCAAAAGCTA

GATCTTTTCTAGATCCTCTAGATGATATAAAGGACTATGAAGATTTATTTACACTGTTGCCGTTGCCTGAAGTC

GCAAAAGTTTATCAAACAAATAATTCCTTCGCTGAACAACGCCTCTCAGGAGCAAATCCATTCGTGATTCGCCT

GCTGGATGAAGATGACCCTCGATCGCAAGTCTTAGAGCAGATTCCTAGTTTTAAAGACGACTTTGAACCATTG

TTCGATGTCCGCAAAGAATTAGCGGCTGGGAACATCTATATTACTGACTATACAGGCACTGATGAATATTATC

GTGGTCCTTCTATGGTTCAGGGTGGTACTTATGAAAAAGGTCGGAAATATTTACCAAAACCGCTAGCTTTCTTT

TGGTGGCAGCGCACTGGGATCAGCGATCGCGGTAAGCTGGTGCCAATCGCTATCCAACTAGATGCCAGCAAG

AATAGCAAGGTATATACTCCGACAAATAGCAAGGTATATACTCCCTTTGAGCAGAATCCACTCGATTGGCTATT

TGCAAAACTTTGCGTTCAAATAGCAGATGGAAATCACCATGAGATGAGTTCCCACTTATGTCGGACACATTTTG

TAATGGAACCGATCGCAATTGGAACTGCTCACCAATTGGCTGAAAATCATCCTCTCAGCCTTCTACTCAGACCA

CACTTCCTATTCATGTTGACCAATAATCATCTTGGACAGCAAAGGTTAATAAATCCAGGTGGTCCTGTTGATGA

GTTGCTGGCTGGTACTTTACCAGAGTCAATGGAGCTAGTTAAGGATGCTTATGAAGGATGGAATATAAAGGA

ATTTGCCTTTCCAACCGAGATTAAGAATCGGGGAATGGATAATACGGAAAGACTACCTCACTATCCTTACCGA

GATGATGGGATGCTTGTTTGGAAAGCTATTCACACTTTTGTATCTGACTATGTTAATCATTTTTACCCAACTCCT

GAAGACATCACTGGAGACACTGAATTGCAAGCATGGGCTAAAGAATTGTCCGATCAATCCGCTCAAACTAATG

GTGGCAAAGTCAAGGGAATGCCAACAAGTTTTACTACTGTTCAAGAACTGATTGAAATCGTTACTACAATCAT

CTTTATCTGTGGTCCCCAGCATTCAGCAGTAAACTACGCTCAGGATGGATATATGACTTTTGCCGCTAATATGC

CCTTAGCAGCTTACCGTGATATTCCTAAGCAAAGTCACAAGCCTCAAGACCAACCTACAGCAACCCCATCTGTA

GCAGTGCAAACTACAGCAGAGCAAACTACAGCAGAGCAAACTAAAGCAGTAGAAATTACAGCAGACAAAGCT

ACATTAGACCAAAATACAGTATTGCAAAAGAGAGCAGTACAAACTACCACAGTAGAAATTCCAGAAGACCAA

ATTACAGAAGAACAAATTCTTAAGTTGCTGCCTCCCTACAAGAGAACTGCCGATCAACTGCAAAGTCTCTTTGT

-continued

TTTGTCAGCCTATCAGTACGACCGATTGGGCTACTATGAAAAAGCCTTTCAACAACTTTATAACGACAAATTTG

AGGATGTTTTTAAAGATGACAATAATCAAGCAATTATTGCCATCGTCAGGCAGTTCCAGCAAAATCTGAATAT

GGTAGAACAAGAAATTGATGCCAATAATAAAAAGCGAGTAGTTCCTTATCTTTACCTAAAACCTTCTCTAATAC

TCAACAGTATTAGCATTTAG

Coding sequence for WP_028091425.1

SEQ ID NO: 63

ATGCAGCCATTTCTACCTCAAAATGACCCGAACCCCTCACAACGCCAATCTTCTCTAGAGAAAGGCCGCAAAG

AGTATCAGTTCATGTATGATTTTTTGCCGCCTATGGCAATGATCAAAAGCGTACCTCCCGCAGAGAATTTTTCT

ACTAAGTATATTGCTGAACGGACATTAGAGGCAGCAGAACTTCCTCTAAATATGATGGCTGTTAAAACTCATG

CTATGTGGGATCCTTTAGATGAATTGCAAGATTATGAGGACTTTTTCCCAGTTTTGCAAAAACCTAATGTGATG

AAAACCTATGAAACCGATGATTCCTTCGCCGAACAACGGCTTTGTGGAGTAAATCCGATGGTTTTACGTCAAA

TTAAGCAAATGCCAGCTAACTTTGCCTTTACCATTGAAGAATTACAGGATAAGTTTGGCAGTTCTATTAATTTA

ATTGAAAGATTGGCCACAGGAAATCTATATGTCGCTGATTATAGATCCTTGGCGTTCATTCAAGGTGGCACTTA

TGCCAAAGGAAAAAAGTACCTACCAGCACCTCTAGCTTTTTTCTGTTGGCGCACTTCAGGCTTTCAAGATCGAG

GCCAATTAGTCCCTGTAGCCATTCAAATCAATCCCAAAGCAGGTAAAGCCAGCCCCTTGCTAACTCCTTTTGAC

GACCCTTTAACCTGGTTTTATGCTAAGTCCTGTGTGCAAATTGCTGATGCTAATCATCATGAAATGAGTAGCCA

TTTATGCCGGACTCACCTGGTAATGGAACCCTTTGCTGTTGTCACTCCTCGTCAACTGGCTGAAAATCATCCTCT

GAGAATATTACTCAAACCCCATTTCCGGTTTATGTTGGCTAATAATGATTTAGCTCGCAAGCGTCTGGTTAGTA

GGGGCGGTTTTGTGGATGAATTATTAGCAGGAACTCTGCAAGAATCATTGCAAATTGTGGTAGATGCCTATAA

AAGTTGGAGTCTAGACCAGTTTGCTCTACCCAGAGAACTCAAAAATCGCGGTGTGAATGATGTCAAAAACTTA

CCACATTATCCTTATCGGGATGATGGAATTTTGTTATGGAATGCGATTAATAAGTTTGTATTTAACTATTTGCAG

CTTTATTATCAGAGTTCAGCAGACTTGAAAGCAGACGCAGAACTGCAAGCTTGGGCGCGGGAATTAGTGGCT

CAGGATGGTGGTAGAGTTAAGGGTATGAGCGATCGCATTGATACCCTAGAACAATTAGTGGAGATTGTTACT

ACTATCATATATATTTGTGGTCCGCAGCATTCGGCGGTTAATTTCTCCCAATATGAATACATGGGTTTTATTCCT

AATATGCCCCTAGCTGCTTATCAACCAATTCAACAAAAGGGTGATATTAAAGACCGTCAAGCCCTCATAGATTT

TCTACCACCTGCCAAGCCCACAAGTACCCAATTATCAACTGTGTACATACTTTCAGACTATCGTTATGACAGACT

GGGATATTATGAAGAGGAAGAATTTACAGATCCAAATGCTGACCAAGTTGTGAATAAATTTCAGCAAGAATTG

AATATGGTACAGAGAAAAATTGAATTGAATAATAAGAGACGTTTAGTAAATTACAAATATCTCCAACCAAGAC

TTATTCTCAACAGTATTAGTATTTAA

Coding sequence for OBQ01436.1

SEQ ID NO: 64

ATGCAGCCATTTCTACCTCAAAATGACCCGAACCCCGCACAACGCCAATCTTGTCTAGAGAAAGGACGCAAAG

AGTATCAATTCATGTATGATTTTTTGCCTCCTATGGCGATGCTCAAAAGCGTACCTCCCGCAGAGAATTTCTCTA

CTAAGTATATTGCTGAACGGACATTAGAGGCAGCAGAACTTCCTCTGAATATGATGGCTGTTAAAACTCATGC

TATGTGGGATCCTTTAGATGAATTGCAAGATTATGAGGACTTTTTCCCAATTTTGCAAAAACCTAATGTGATGA

AAACCTATGAAACCGATGATTCTTTCGCCGAACAACGGCTTTGTGGGGTGAATCCGATGGTTTTACGTCAAATT

AAGCAAATGCCAGCTAACTTTGCCTTTACCATCGAAGAATTACAGGCTAAGTTTGGCAATTCTATTAATTTAAT

CGAAAGATTGGCAACAGGAAATCTATATGTCGCTGATTATAGATCCTTGGCGTTCATTCAAGGTGGCACTTAT

GCCAAAGGAAAAAAGTACCTACCAGCACCTCTGGCCTTTTTCTGTTGGCGCAGTTCGGGCTTTCAAGATCGAG

GACAATTAGTCCCTGTAGCCATTCAAATCAATCCCAAAGCAGGTAAAGCCAGCCCCTTGCTGACTCCTTTTGAT

GACCCTTTAACCTGGTTTTATGCTAAGTCCTGCGTGCAAATTGCTGATGCTAATCATCATGAAATGAGTAGCCA

TTTATGTCGGACTCACTTAGTAATGGAACCCTTTGCTGTTGTCACCCCGCGTCAACTGGCTGAAAATCATCCTCT

GAGAATATTACTCAGACCCCATTTCCGGTTTATGTTGGCTAATAATGATTTAGCTCGCAAACGTCTGGTTAGTA

-continued

GGGGCGGTTTTGTGGATGAATTATTAGCAGGAACTCTGCAAGAATCATTGCAAATTGTGGTAGATGCCTATAA
AAGTTGGAGTCTAGACCAGTTTGCTCTACCCAGGGAACTCAAAAATCGCGGTGTAGATGATGTGAAAAACTTG
CCACATTATCCTTATCGGGATGATGGAATTTTGTTATGGAATGCGATTAATAAGTTTGTATTTAACTATTTGCAG
CTTTATTACAAGAGTCCAGCAGACTTGAAAGCAGACGGAGAACTACAAGCTTGGGCGCGGGAATTGGTGGCT
CAGGATGGTGGTAGAGTTAAGGGTATGAGCGATCGCATTGATACCTTAGAACAATTAGTTGAGATTGTTACTA
CTATCATATATATTTGTGGTCCTCAGCATTCGGCGGTTAATTTCTCCCAATATGAATACATGGGTTTTATTCCTA
ATATGCCCCTAGCTGCTTATCAAGAAATTCAACAAAACGGTGATATTGAAGACCGTCAAGCCCTGATAGATTTT
CTACCACCAGCAAAGCCCACAAATACCCAATTATCAACTGTGTACATACTTTCAGACTATCGTTATGACAGACT
GGGATATTATGAAGAGGAAGAATTTACAGATCCAAATGCTGACCAAGTTGTGAATAAATTTCAGCAAGAATTG
AGTGTGGTACAGAGAAAAATTGAATTGAATAATAAGGGACGTTTAGTAAATTACGAATATCTCCAACCCGGAC
TTATTCTCAACAGTATTAGTATTTAA

Coding sequence for OBQ25779.1

SEQ ID NO: 65

ATCATAAATATCATGCAGCCATTTCTACCTCAAAATGACCCGAACCCCGGACAACGCCAATCTTCTCTAGAGAA
AGGACGCAAAGAGTATCAATTCATGTATGATTTTTTGCCTCCTATGGCGATGCTCAAAAGCGTACCTCCCGCAG
AGAATTTCTCTACTAAGTATATTGCTGAACGGACATTAGAGGCAGCAGAACTTCCTCTAAATATGATGGCTGTT
AAAACTCATGCTATGTGGGATCCTTTAGATGAATTGCAAGATTATGAGGACTTTTTCCCAGTTTTGCAAAAACC
TAATGTGATGAAAACCTATGAAACCGATGATTCCTTCGCCGAACAACGGCTTTGTGGGGTGAATCCGATGGTT
TTACGTCAAATTAAGCAAATGCCAGCTAACTTTGCCTTTACCATCGAAGAATTACAGGCTAAGTTTGGCAATTC
TATTAATTTAATCGAAAGATTGGCCACAGGAAATCTATATGTCGCTGATTATAGATCCTTGGCGTTCATTCAAG
GTGGCACTTATGCCAAAGGAAAAAAGTACCTACCAGCACCTCTAGCCTTTTTCTGTTGGCGCAGTTCAGGCTTT
CAAGATCGAGGCCAATTAGTCCCTGTAGCCATTCAAATCAATCCCAAGGCAGGTCAAGCCAGCCCCTTGCTAA
CTCCTTTTGATAAACCTTTAACCTGGTTTTATGCTAAGTCCTGTGTGCAAATTGCTGATGCTAATCATCATGAAA
TGAGCAGCCATTTATGTCGGACTCACCTGGTAATGGAACCCTTTGCTGTTGTCACCCCGCGTCAACTGGCTGAA
AATCATCCTCTGAGAATATTACTCAAACCCCATTTCCGGTTTATGTTGGCTAATAATGATTTAGCCCGCAAGCGT
CTGGTTAGTAGGGGCGGTTTTGTTGATGAATTATTAGCAGGAACTCTGCAAGAATCATTGCAAATTGTGGTAG
ATGCCTATAAAAGTTGGAGTCTGGACCAGTTTGCTCTACCTAGGGAACTCAAAAATCGCGGTGTAGATGATGT
GAAAAACTTGCCACATTATCCTTATCGGGATGATGGAATTTTGTTATGGAATGCGATTAATAAGTTTGTATTTA
ACTATTTGCAGCTTTATTACAAGAGTCCAGCAGACTTGAAAGCAGACGGAGAACTGCAAGCTTGGGCGCGGG
AATTAGTGGCTCAAGATGGTGGTAGAGTTAAGGGTATGAGCGATCGCATTGATACCTTAGAACAATTAGTTG
AGATTGTTACTACTATCATATATATTTGTGGTCCTCAGCATTCGGCGGTTAATTTCTCCCAATATGAATACATGG
GTTTTATTCCTAATATGCCCCTAGCTGCTTATCAAGCAATTCAACAAAAGGGTGATATTAAAGACCGTCAAGCC
CTGATAGATTTTCTACCACCTGCCAAGCCCACAAATACCCAATTATCAACTGTGTACATACTTTCAGACTATCGT
TATGACAGACTGGGATATTATGAAGAGGAAGAATTTACAGATCCAAATGCTGACCAAGTTGTGAATAAATTTC
AGCAAGAATTGAATGTGGTACAGAGAAAAATTGAATTGAATAATAAGGGACGTTTAGTAAATTACGAATATCT
CCAACCCAGACTTATTCTCAACAGTATTAGTATTTAA

Coding sequence for WP_039200563.1

SEQ ID NO: 66

ATGAAGCCATTTTTACCTCAAAATGACCCAAATCCCACACAACGCCAATCTTCCCTAGAGAAAGGTCGCAAAG
AGTATGAATTTAGGTATGATTTTTTGCCTCCTATGGCGATGCTCAAAAACGTACCTCCCTCTGAGAATTTTTCTA
CCAAGTATATTGCTGAACGGACAATAGAGACAGCAGAACTTCCTAGCAATATGATGGCTGTCAAAGCCCATGC
TATGTGGGACCCCTTAGATGAATTGCAAGACTATGAAGACTTTTTTCCAGTTTTGCAAAAACCTAATGTGATGA

-continued

AAAATTATGAAACAGATGATTCCTTCGCCGAACAACGGCTTTGTGGCGTGAATCCTGTGGTTTTATGTCAGATT

AAGCAAATGCCAGCCAACTTTGCCTTTACCATCGAAGAATTGCAAGCTAAGTTTGGCAATTCTATTGATTTAAG

AGAAAGACTGGCAACCGGAAATCTCTATGTAGCTGATTATAGACCTTTGGCGTTCATTCGAGGTGGCACTTTC

GCCAAAGGGAAAAAGTATTTACCAGCACCACTAGCCTTTTTCTGTTGGCGGAGTTCAGGCTTTCAAGATCGTG

GTCAATTAGTACCTATAGCGATTCAAATCAATCCCAAGGAAGGAAAAGCCAGCCCATTGCTGACCCCTTTTGAT

GACTCTTCTACCTGGTTTTATGCCAAGTCCTGTGTGCAAATTGCTGATGCTAATCATCATGAAATGAGTAGCCA

TTTATGCCGGACTCACTTTGTGATGGAACCCTTTGCGGTTGTTACTCCTCGTCAATTAGCCCAGAACCATCCGCT

GAGAATATTACTAAAACCCCATTTCCGGTTCATGTTGGCCAACAATGATTTAGGTCGCCAGCGGTTGGTGAAT

AGAGGCGGTCCTGTTGATGAATTATTAGCGGGAACTCTGCAAGAATCACTGCAAATTGTTGTAGATGCTTATA

CAGATTGGAGATTGGATCAGTTTGCGCTGCCAACAGAACTCAAAAATCGCGGTGTGGATGATGTGAAAAATT

TGCCCCACTATCCCTATCGGGACGATGGGATCTTGTTGTGGAACGCGATTAACAAGTTTGTGTTTAACTATTTG

GAGCTTTACTACAAGAGTCCCGCAGACTTGACAGCAGATGTCGAACTACAAGCTTGGGCGCGGGAATTAGTG

GCTCAGGATGGTGGTAGAGTCAAGGGGATGAGCGATCGCATTGATACTTTGAAACAATTAGTAGAGATTGTT

ACTACTATCATTTACACTTGTGGACCTCTGCATTCTGCTGTTAATTTCCCCCAATATGAATACATGGGTTTCATTC

CCAATATGCCTCTGGCTGCTTATCAACCAATTAAAAAAGAAGGCGTTTGTACCCGCAAGGAACTGATAGATTTT

TTACCAGCTGCCAAACCAACAAGTAGCCAATTAACAACTTTATTCACACTCTCAGCCTATCGTTATGACAGACT

AGGATATTATGAAGAGGAAGAATTTGAAGACCCCAATGCTGACGATGTTGTGAATAAATTCCAGCAAGAATT

GAATGTGGTGCAAAGAAAAATTGAGTTGAGCAACAAGGGACGTTTAGTAAATTACGAATATCTACAACCCAG

ACTTATCCTCAACAGCATCAGCATTTAA

Coding sequence for WP_012407347.1

SEQ ID NO: 67

ATGAAACCATACCTCCCTCAGAATGATCCTGACCCTACAAAACGTCAAATATTGCTAGAGAGAAATCAAGGGG

AGTATGAATTTGATTACGACTTTTTGGTACCTATGGCAATGCTAAAAAATGTACCTTCTATAGAAAACTTTTCAA

CTAAGTATATTGCTGAACGGACATTAGAGACAGCAGAACTGCCTATAAATATGTTAGCCGTTAAAACCCGTTC

TTTATGGGACCCTTTAGATGAATTGCAAGACTATGAAGACTATTTTCCAGTTTTGCCTAAACCTAATATTATCAA

AACATACCAAAGTGATGACTCTTTTTGTGAGCAACGGCTTTGTGGGGCAAATCCTTTTGTTTTACGTCGAATTG

AGCAGATGCCAGATGGCTTCGCCTTTACCATTTTAGAATTGCAAGAAAAAATTTGGTGACTCTATTAACTTAGTA

GAAAAACTTGCGAATGGAAATTTATATGTAGCTGATTACAGAGCGCTTGCGTTTGTTAAAGGAGGTAGTTATG

AAAGAGGTAAGAAGTTTTTACCAACCCCTATAGCTTTCTTTTGTTGGCGCAGTTCTGGTTTTAGCGATCGCGGT

CAACTAGTACCGATTGTTATCCAAATCAACCCCGCAGATGGCAAACAGAGCCAGCTAATTACACCTTTCGATGA

CCCTTTAACCTGGTTTCATGCCAAGCTTTGTGTTCAAATTGCTGATGCTAACCATCATGAAATGAGTAGCCATCT

GTGTCGAACTCACTTTGTTATGGAACCCTTTGCTATTGTCACAGCCCGTCAACTAGCCGAGAACCATCCCCTTA

GCTTACTGCTAAAACCCCACTTCCGTTTCATGTTGGCTAATAATGACTTGGCTCGTAAGCGCCTAATTAGTAGA

GGTGGGCCTGTTGACGAATTGCTAGCCGGAACTCTGCAAGAGTCATTGCAAATTGTCGTTAACGCATATACAG

AATGGAGCTTAGATCAGTTTTCCTTACCTACTGAACTAAAAAATCGGGGTATGGATGATCCAGACAACTTACCT

CACTATCCCTATCGAGACGATGGCTTATTATTGTGGAATGCCATTAAAAAGTTTGTGTCTGAATACTTGCAGAT

ATACTACAAAACTCCCCAAGATTTAGCAGAAGACTTGGAATTACAAAGTTGGGTGCAGGAATTAGTTTCCCAA

TCAGGCGGACGAGTCAAGGGTATTAGCGACCGCATCAACACATTAGACCAATTAGTTGATATTGCTACTGCGG

TTATCTTCACCTGTGGGCCGCAACACGCTGCTGTTAACTACTCACAATATGAATATATGACTTTCATGCCAAATA

TGCCTCTTGCTGCTTATAAACAAATGACATCAGAAGGCACTATTCCTGACCGTAAAAGTCTATTATCATTTCTGC

CACCGTCAAAGCAAACTGCTGACCAATTATCGATTTTATTTATCCTGTCGGCCTACCGTTATGACAGATTAGGG

TACTACGATGATAAATTTTTAGACCCAGAGGCTCAGGATGTTTTAGCTAAATTCCAGCAGGAGTTGAATGAAG

-continued

CAGAGCGGGAAATTGAGTTGAATAACAAGAGTCGTTTAATAAATTACAACTATCTCAAACCAAGGCTTGTGAC

TAATAGTATTAGCGTGTAA

Coding sequence for WP_027843955.1

SEQ ID NO: 68

ATGAAACCCTATCTTCCTCAAAATGACCCTAACCCTGAGAAGCGGAAAGATTGGCTTAATAAAAATCGTGAAG

AGTACCAATTTAACTTCAATTATCTTTCTCCCCTCCCATTAATTGATGATGTTCCTAATAATGAGGCTTTTTCCCC

TAAATACCTTGCAGAACGCTTACCTTTAACTTTCGGTAAATTATCTGCTAATACCTTGGGAATTAGACTTCGCTC

TTTTTGGGATCCTTTTGATGAATTCCAAGATTATGAGGACTTTTTCCCTGTTTTACCAACACCGGAATTACTCAA

GACCTACCAAAATGACGAATACTTTGCCGAACAAAGGCTAAGTGGAGTAAATCCTATGGTAATACGCAGTATT

AAGGAACTACCCCCTCACTTTGCATTTTCCATCCGAGATTTACAGGCTGAATTTGGTACATCCCTAAATTTAGA

GCAAGAACTGAACAACGGAAATCTATATATCGCAGACTATACCAGTCTTTCATTTGTTCGGGGAGGAAGCTAT

CTTAGGGGTCGAAAGTCTTTACCTGCACCCATAGCCTTATTTTGCTGGCGTAATTCTGGTTATTGCGATCGCGG

AGAATTAACCCCAATCGCTATTCAACTAGTACCGGAACTTGGTACGGGAAGTAGAATTTTAACTCCTTTTGATT

CTCACCTTAACTGGTTATATGCCAAAATTTGTATGCAGATTGCAGATGCAAATCATCATGAAATGAGTAGCCAT

TTATGTCATACTCACCTAGTGATGGAACCTTTCGCAGTTGTAACAGCTCGACAGCTAGCTGAAAATCATCCGTT

GGGTTTGTTGCTGCGTCCCCACTTCCGGTTCATGCTCCACAACAATGAATTAGCCCGTAAAAATTTAATTAATC

AAGGTGGGTACGTTGATAATCTCCTTGGGGGAACCTTAAGAGAATCCCTACAAATTGTCCGGGATGCTTACTT

TAAAAATGCTGAAGAATTTTGGAGCTTAGACGAATTTGCTTTACCTAAAGAAATCGCAAATCGTGGCTTAGAT

GATACTGATCGCTTACCCCACTACCCCTACAGAGATGATGGAATGTTACTGTGGAATGCGATCGAGAAATTTG

TATCGAATTATTTGAGTATATATTATCCAAATCCAGGGGACATTAAAGATGATCGCGAACTGCAAGCTTGGGC

TGCAGAATTAGTTGCTGCTGATGGTGGACGAGTAAAAGGGGTACCCTCACAATTTGAAAATCTGCAACAATTA

ATCGACGTTGTAACTGGCATTATTTTTACATGCGGACCTCAGCACTCTGCTGTAAATTATCCCCAATATGAATAT

ATGGCATTTGTTCCGAATATGCCCCTCGCAGGTTACCAAGCTGTGGATTCTAATCCCAACATGGATCTGAAAAG

TTTAATGGCGTTTCTCCCCCCACCCAATCAAACTGCAGATCAACTACAAATTATTTACGGATTATCAGCTTATCG

TTATGACCGCTTGGGTTACTACGACCGAGAATTTAGCGATCCTCATGCTGAAGAAGTTGTCAGACTATTTCAAC

AAGATTTAAATCAGGTGGAACGTAAAATTGAGTTACGTAACAAAAATCGCTTGGTTGAATATAACTTCCTCAA

GCCTTCTTTAGTTCTTAATAGTATCAGTATATAA

Coding sequence for WP_073641301.1

SEQ ID NO: 69

ATGAAACCATACCTTCCTCAAAATGACCCTGACCCGATAAAACGCAAATATTCCTTAGAGCATAAGAAAGAAG

AATACGAATTCGATCACGACTTTTTATCACCGATGGCAATGCTCAAAGATGTACCTGCTGTCGAAAATTTTTCT

ACCAGGTATATTGCTGAACGTACAGTAGAGACAGCAGAGCTTCCTATCAATATGTTGGCTGTTAAAACCCGTG

CTTTATGGGACCCTTTAGATGAATTGCAAGACTATGAAGACTATTTTCCAGTCTTGCCTAAACCTAATGTCATCA

AAACATACCAAACAGATGATTCTTTTTGCGAACAACGCCTGTGTGGGGCGAATCCTATGGCTTTACAGCAAAT

TAAAGAGATGCCGTTGGGGTTTGAATTTACCATCGAAGAACTGCAAGAAAAGTTTGGCGAATCTATCAATTTG

GTAGAAAAACTTGCTGATGGAAATTTATATGTGACTGATTACAGACCGCTTTCATTTGTAAAAGGTGGTACTTA

CGAGAGAGGTAAAAAGTATTTACCAACACCCCTAGCTTTTTTCTGTTGGCGGAGTTCTGGGTTTAGCGATCGC

GGTCAACTCGTACCTATTGCCATCCAACTCAATCCCGCAGTCGGCAGACAAAGCCAATTAATCACACCTTTTGA

CGATCCTTTAACTTGGTTTCATGCCAAACTTTGTGTTCAAATTGCTGATGCTAACCATCATGAGATGAGTAGCC

ATCTTTGCCGAACTCACTTTGTCATGGAACCTTTCGCCATTGTCACAGCCCGTCAATTAGCTGATAATCATCCTC

TCAATTTGTTATTAAAACCCCACTTCCGTTTCATGTTGGCTAATAATGACTTGGGTCGCAAGCGCTTAGTTAATA

GGGGCGGACCTGTTGATGAATTGCTAGCTGGAACTCTGCAAGAATCATTGCAAATTGTCGTCAACGCCTATAA

-continued

AGAATGGAGTCTAGATGAATTTGCCTTACCCACTGAAATCAAAAATCGGGGTATGGATGATAAACTAAAATTG

CCTCACTATCCCTATCGAGACGATGGGATGCTATTGTGGAATGCTATTAAAAAGTTTGTGTCTGAATACTTGAA

GTTATACTATAAAACTCCCCAAGATTTGACAGCAGACTTAGAATTGCAAGCTTGGGCGCAGGAATTAGTTTCT

GAATCAGGCGGACGAGTTAAAGGCGTTCCCTCTCGCATTGAAAAATTAGAACAATTAGTTGATATTGCGACTG

CGGTAATTTTCACCTGTGGACCACAACACGCTGCTGTTAACTATTCACAATATGAATATATGACCTTCATGCCG

AATATGCCCCTTGCTGCTTATAAACAAATGACAGCAGAAGGCACTATTGCTGACCGCAAAAGCCTATTATCATT

TCTGCCACCGTCAAAGCAAACTGCCGATCAATTGTCGATTTTATTCATCCTGTCAGCTTACCGTTATGATAGGTT

AGGTTACTATGACGATAAGTTCGCAGACCCAGAAGCTCAGGATATTCTAGTTACATTTCAGCAGGATTTGAAC

GAGGTAGAGCGTAAAATTGAGTTGAACAACAAGAGTCGTTTAATAAAGTATAACTACCTCAAACCAAGGCTTG

TTACCAATAGCATTAGCGTCTAA

Coding sequence for WP_096647440.1

SEQ ID NO: 70

ATGAAACCATATCTTCCACAGAATGATCCTGAACCTACACAACGCAAGAATTTCCTGGAGCGCAAACAAGGAG

AGTATGAATTTGATCACAAATTTTTAAAGCCTATGGCAATGCTAAAAAATGTACCCTCTATTGAAAATTTTTCTA

CTAAATATATTGCTGAACGTACGGTAGAGACGGCAGAACTTCCTCTAAATATGTTAGCCGTTAAAACTCGTTCT

TTGTGGGATCCTTTAGATGAATTGCAAGACTATGAAGACTATTTTCCAGTTTTACCTAAACCTAATGTCATCAA

AACATACCAAACTGATAACTCTTTCTGTGAACAACGGCTTTGTGGTGCAAATCCTTTAGTTTTACGCCAAATTCA

GCAGATGCCAGATGGCTTTGCCTTTACCATTTCAGAACTGCAAGAAAAAGTTCGGTGACTCTATCGACTTAGAA

GAAAGACTTAAAACTGGAAATTTATATGTAGCTGATTACAGAGCGCTTGCATTTGTTAAAGGAGGTACTTATG

AAAGAGGTAAGAAGTATTTACCCACTCCCATAGCGTTCTTTTGTTGGCGTAGTTCTGGTTTTAGCGATCGCGGT

CAACTAGTACCGATTGCTATCCAAATCAATCCCACAGATGGTAAACAGAGTCAGTTAATCACACCTTTTGATGA

GCCTTTGGTCTGGTTTCATGCCAAACTTTGTGTTCAAATCGCTGATGCTAACCATCATGAAATGAGTAGTCATC

TGTGTCGAACTCACTTTGTAATGGAACCCTTCGCCATTGTCACAGCCCGTCAACTAGCAGATAACCATCCCCTC

AACTTATTGCTTAAACCCCACTTCCGTTTCATGTTAGCTAATAATGAATTAGGTCGTCAGCGCCTAGTTAATAGA

GGTGGGCCTGTTGACGAATTGCTAGCGGGAACTTTGCAAGAGTCATTGCAAATTGTCGTCAACGCATATAAAG

AATGGAGCTTAGATCAGTTTTCTTTACCCACCGAACTCAAAAATCGGGGTATGGATAATTCAGACAAACTACCT

CACTATCCTTATCGAGACGATGGCTTACTATTGTGGAATGCCATTAAAAAATTTGTGTCTGAATACTTGAAACT

ATACTATAAAACTCCTCAAGATTTAACAGCAGACTTTGAATTACAATCTTGGGCGCAGGAATTAGTTTCCCAAT

CAGGCGGGCGGGTCAAGGGCGTTAGCGACCGCATTACAACATTAGACCAATTAATTGATATTGCTACGGCGG

TTATTTTCACCTGTGGGCCACAACACGCTGCTGTTAATTACTCACAATATGAATATATGACTTTCATTCCCAATA

TGCCCCTCGCTGCTTATAAACAAATAACATCAGAAGGAAATATCCCTGATCGTAAAAGCCTACTATCATTTCTT

CCACCATCAAAGCAAACTGCTGATCAATTATCGATTTTATTCATCTTGTCCGCCTACCGTTATGACAGATTAGG

GTACTATGACGATAAATTTTTAGATCCGGAGGCACAGGAGATTTTAGTTACATTTCAGCAGGAGTTGAACGAA

GCAGAACGGCAAATTGAGTTGAACAATAAAAGCCGTTTAATAAATTACGACTATCTGAAACCAAGGCTTGTTA

CTAATAGCATCAGCGTATAA

Coding sequence for WP_099099431.1

SEQ ID NO: 71

ATGAAACCATATTTACCACAAAAAGATCCTGATGTTAAGGTCCGAATCAATTGGCTAGATAAAAATCGAGAAG

AGTACAAATTTAATTACGATTATCTAGCTCCTCTACCAGTAATTGATAAAGTTCCTCATAAGGAAATATTCTCGG

CAGAATATACTACTAAACGTTTGGCAAGTATGGCAAGTCTTGCACCAAATATGCTAGCTGCCAAAGCCAGAAA

CTTCTTAGACCCATTAGATGAATTGGAAGAATATGAAGAACTTTTGTCACTACTACCAAAACCCGATGTCATAA

AAAATTACAAAACAGACTCCTGTTTTGCGGAACAACGACTCTCTGGAGCGAACCCATTAGCTATCCAAAAAATT

GATGTATTACCTGATAATTTTGCTGTCACAGATGCACATTTTCAGAAGGTTGCAGGTACAGAATTTACTTTGGA

-continued

AAAAGCACTCAAGGAAGGCAAGCTGTATTTCTTAGATTATCCTTTGTTATCTGATATTAAAGGTGGTGTCTACA

ATAATGTTAAAAAGTACCTTCCCAAGCCACAAGCTCTATTTTATTGGCAAAGTAATGATAGTCCTAATGGTGGT

TCTCTAGTGCCTGTTGCCATCCAGATTAATCATGACTCTGGTGGAAAAAGCGTGATTTATACACCAGATGACCC

CCATTTAGATTGGTTTTTGGCAAAAACCTGCGTTCAAATTGCTGATGGCAACCATCAAGAATTGGGTAGTCATT

TCGCCTATACCCATGCAGTTATGGCTCCGTTTGCAATTGTAACTGCGCGGCAGCTAGCAGAAAATCATCCCATC

GCCTTACTGTTAAAACCCCACTTCCGTTTTATGCTATTTGATAACGATTTGGGGCGCACTCAGTTTTTACAACCT

GGAGGCCCGGTTGATGAGTTTATGGCAGGTTCATTGGCGGAGTCTCTTGGATTTGTAGCGAAGGTTTATGAA

GAATGGAGTGTGGAAAAATTTACCTTCCCTCGGTTAATAAAAAGTCGCCGAACGGATGACCCAGAAATTTTAC

CGCACTTTCCTTTCCGGGACGATGGTATGTTAATTTGGAATGCCGTCGAAAAGTTTGTGTATGAATATTTGCAA

CTCTATTACAAAACCTCACAGGATCTAATTGATGACTATGAGTTGCAAAATTGGGCTAGAGAATTAGTGGCTC

AAGATGGTGGTAGAGTCAAGGGAATGCCAGCCAAGATTGAGACTCTAGAACAACTGATTGAAATCATCAGTG

TGGTAGTATTCACTTGCGCTCCTCTACACTCTGCTTTGAATTTTTCTCAGTACGAATATATGGCTTTTGTACCCA

ATATGCCCTATGCAGCTTATCACCCAATTCCAGAAACTAAAGGTGTGGATTTGGAAACTATTATGAAGATACTT

CCTCCCTTTAAACAAGCTGCCGACCAGGTGATGTGGACTGAGATTTTAACATCATACCACTATGATAAATTGGG

TTTTTATGATGAGGAGTTTGCCGATCCATTAGCGCAGGAAATTGTGGTGCAATTCCAACAGAATTTGCATGAA

ATAGAACGGCAAATAGACATTAGAAATCAAACTCGTCCCATACCTTATAACTACTTCAAGCCTTCGCAAATTAT

TAACAGCATTAATACTTGA

Coding sequence for WP_052672367.1

SEQ ID NO: 72

ATAAAACCATATTTACCTCAACACGAGCCTGATGCGATCGCGCGGCAAAATCGCTTAATCAAAAACCGCGCTG

ATTATGTTCTCGACTATAACTATCTGCCACCTATTCCTTTGCAAACTCCTGTTCCTCAACAAGAACGTTTTTCTGC

TGAATACACTGCAAGGCGTTTAGCTAGTTTTGCTAATCTCGTCCCCAATATGTTGATGGCGAGGGCGAGAAAT

GCTTTCGATCCTTTAGATACGTTAGAGGAATACGCGGACTTATTACCAGTCTTACCAAAACCTAATGTCATCAA

AAATTATCAAGCAGATTGGTGTTTTGCCGAACAAAGATTATCTGGTATTAACCCGCCAGCTATCCGCCGCATAG

ATGCTTTGCCAGAAAATTTGCCCATCTCTAACTCTTCGTTTCAACACTCTGTAGGTGCAGAACATAATCTGGAA

CAAGCACTCAAAGAAGGTAAGTTGTATTGTTTAGACTACCCGTTGTTATCTGGTATTGGAGGCGGTAATTACC

AGAATTTACCTAAATATCTGCCCAAACCGCAAGCGCTCTTTTATTGGCGTAGTGATAATAGCAAAATCGGCGG

CTCTTTAGTTCCGGTAGCGATTAAAATTCTCAATGAATTGGGAGGGAAAAATTTAGTCTATACGCCCAATGATG

CACCTCTCGACTGGTTTCTTGCCAAAACCTGCGTGCAAATGGCAGATGCAAACCATCAGGAATTAGGCACTCA

TTTTGCTAAAACTCATGCTGTTATGGCTCCTATTGCGGCAATTACAGCTAGGGAATTAGGCGAAAACCATCCTT

TAACTTTGCTGCTAAAACCTCATTTCCGGTTCATGCTGTTTGATAATGAGTTAGGACGCACGCAGTTTTTGCAA

CCTACTGGTCCTACTGAAGAACTGCTAGCTGGAACGCTGGAAGAATCTGTGCAATTGGTCGTGCAAGCTTATG

AGGAATGGAGTATAGATACTACTTTTCCTTTAGAATTGCAGCAACGGCAAATGCATGACCCAGAGATTTTACC

TCATTACCCGTTCCGAGATGATGGCATATTAGTCTGGAATGCTATACATCAGTTTGTTACTGAATATTTGCAGA

TTTACTACCACACTCCGCAAGATATCAGTGCAGACTACGAGGTGCAAAATTGGGCTAGGGAATTGGTAGATA

GCGGTCGAGTTAAAGGAATGCCAGAGAGCATTGATACTCTAGCACAACTAATTGACATTATCGCTGTAGTCAT

CTTTACCTGCGCTCCTCTGCATTCTTGCTTGAATTTAGCCCAGTACGAATACATGACTTTCGTGCCAAATATGCC

TTATGCAGCCTACCACCCTATTCCCACTACTAAGGGCGTAGATATGGCAACTATTGTCAAAATTATGCCGCCTT

TTCAAAGAGCGATCGATCAAATATTGTGGACGGATATTTTGAGCGCTTTCCAATATGACAAGTTGGGTTTTTAT

GAGGAAGATTTTGCCGATCCCAAGGCTCAGGAAGTGCTACAGCGCTTTCAAGATAACTTGCAGCAGGTAGAA

-continued

GAAAAGATAGAAATGCACAATCAGATTCGCCCAATACCTTACAACTACCTCAAGCCTTCTCGGATTATGAACA

GCATTAATACTTAA

Coding sequence for WP_073631249.1

SEQ ID NO: 73

ATGAAACCCTACTTACCCCAACATGACCCAAATCCTGAAGCTCGGAGAAATTGGCTGGAACAAAACCGAGAA

GACTACAAATTTGACCACAATTATTTGGCTCCCATACCAATACTTGATAAGGTGCCTCATAAAGAACTCTTCTC

GCCGCAATATACCGCTAAGCGCTTAGCAAGTATGGCGGATCTCGTACCCAATATGCTTGCTGCCAAAGCCAGA

AATTTCTTCGATCCACTGGATGAATTGGAAGAATATGAAGCCCTGTTGTCGATATTACCAAAGCCCTCTGTCAT

AAAAAATTACAAAACAGATTCGTGTTTCGCCGAGCAAAGACTCTCTGGGGCAAACCCGATGGCAATGCACAG

GATTGACGAGCTACCAGAAAAATTCCCTGTGACAAACGACCACTTTCAAAAAGCTGTAGGTGCAGAACACAAT

TTGGAGGCGGCACTCAAAGAAGGCAAACTCTATTTATTAGATTATCCTTTGCTATTTGACATTAAAGGCGGTAC

CTACCAGAACATTAAAAAGTACCTTCCCAAGCCGCAGGCTCTATTTTACTGGCAAAGCAATGGCAATAAAAAT

AGTGGTTCTCTGGTGCCTATCGCCATTCAGATCCATAATGATACTGGTGGAGATAGCCTGATTTACACACCAGA

TGACCCCCATTTAGATTGGTTTTTGGCAAAAACCTGCGTACAAATTGCTGATGCCAACCATCAGGAATTGGGTA

GCCATTTTGCACGTACTCATGCAGTCATGGCTCCATTTGCAATTGTCACTGCTCGACAGTTGGGAGAAAACCAT

CCCCTCGCCTTACTTCTGAAACCCCACTTCCGATTCATGCTCTATGATAACGATTTGGGACGTACTCACTTTTTA

CAAGCAGGAGGTCCGGTTGATGAGTTTATGGCAGGTACGTTGCAGGAGTCTCTTGGTTTCGTTGCCAAAGCCT

ACGAAGAATGGAGTTTAGACAATGCTGTCTTCCCGACGGAAGTGAAGAATCGCAAAATGGATGATCCAGACA

TTTTGCCGCACTATCCTTTCCGGGACGACGGGATGTTACTCTGGGATGCGGTCAAAAAGTTTGTGACTGAATA

CTTGCAACTCTATTACAAAACTCCCCAAGACTTGAGCGAGGATTATGAATTGCAAAATTGGGCGAGAGAATTG

GCTGCCCAAGATGGTGGTTGTGTCAAGGGGATGCCAGAGAAAATTGAGACCATAGAGCAACTCATTCATGTT

GTGACTGTAGTCGTCTTCACCTGCGCTCCTCTCCACTCGGCTTTGAATTTTTCCCAGTACGAATACATGGCTTTC

GTACCCAATATGCCTTATGCAGCCTATTACCCCGTTCCAGAAACAAAGGGTGTGGATATGCAGACTATCATGA

AGATGCTTCCACCTTTTAAGCAAGCTGCTGATCAGGTGATGTGGTCGGATATTTTGACATCCTTCCATTACGAC

AAATTGGGTCACTATGATGAAGAATTTGCCAACCCAATGGCTCAGGCAATTCTTTTGCAGTTCCAACAAAATTT

GCATGAAGTGGAACGACAAATAGAAATCAAAAATCAATCTCGTCCAATACCATATAACTACCTCAAGCCTTCT

GAAATTATTAATAGCATCAATACTTGA

Coding sequence for WP_013220336.1

SEQ ID NO: 74

ATGAATACCTCGCTACCGCAAAATGATTCCGATCCCCAGGGCCGAAAGGATCGGCTTGAAAGACGGCGAGCG

CTGTATGTATTTAATTACGATTATGTGCCGCCCATACCGATGATTGATAAGGTCCCTCATGAAGAGTATTTCAG

TCCAAAATACACTGCAGAACGTTTGGCGTCCATGGCGAAGCTAGCGCCTAATATGCTTGCCGCTAAAACCAAG

CGGCTCTTCGACCCGCTTGATGAACTGAATGAATATGATGAGATGTTCATCTTCCTGGACAAACCGGGTATTGT

CCGCGGCTATCGAACAGATGAATCCTTTGGGGAACAACGCCTATCCGGCGTTAATCCCATGTCAATACGCCGC

CTTGATAAACTCCCCGAAGACTTTCCGATCATGGATGAGTATCTGGAACAAAGTTTGGGTTCTCCACATACTCT

CGCGCAGGCACTCCAAGAAGGACGGCTTTATTTTCTGGAGTTCCCTCAATTGGCTCATGTGAAAGAAGGCGGA

CTTTACCGGGGACGGAAAAAATACCTGCCCAAGCCCCGGGCTTTATTTTGCTGGGACGGGAATCATTTGCAGC

CGGTGGCCATCCAAATTAGCGGACAACCAGGGGGGCGGCTCTTTATTCCCCGGGATTCTGATTTAGATTGGTT

TGTAGCCAAGTTGTGCGTCCAGATTGCCGATGCCAATCATCAGGAACTTGGCACCCACTTTGCCCGTACTCATG

TGGTGATGGCGCCTTTTGCCGTGGTGACCCACCGTCAATTGGCGGAAAATCATCCTCTGCATATTCTGTTGCG

GCCTCATTTCCGGTTCATGCTCTACGACAATGATTTGGGGCGTACCCGATTTATCCAGCCAGATGGTCCGGTG

GAGCACATGATGGCGGGCACTCTAGAAGAGTCCATTGGGATTTCCGCTGCCTTTTATAAGGAATGGCGGCTA

-continued

GATGAAGCCGCCTTTCCCATTGAAATTGCCCGCCGCAAGATGGATGACCCGGAGGTATTGCCCCATTATCCCTT

CCGGGACGATGGGATGCTGCTATGGGACGGTATTCAGAAATTTGTGAAGGAATACTTGGCCCTTTATTATCAA

AGTCCTGAAGATTTGGTCCAGGACCAGGAACTGCGGAACTGGGCTAGGGAGCTTACCGCCAATGACGGGGG

CCGGGTAGCGGGTATGCCGGGGCGTATTGAAACCGTCGATCAGCTTACCAGCATCCTTAGCACGGTCATTTAT

ACTTGTGCACCCTTGCACTCGGCACTGAATTTTGCCCAGTACGAGTATATCGGCTATGTCCCGAATATGCCCTA

TGCGGCCTATCACCCCATTCCCGAAGAGGGAGGCGTGGATATGGAAACGCTGATGAAAATTCTGCCTCCCTAC

GAGCAGGCTGCGCTGCAGCTGAAATGGACCGAGATCCTCACTTCCTACCATTATGATCGCTTGGGACATTATG

ATGAAAAATTCGAAGATCCCCAGGCGCAAGCCGTAGTGGAACAATTCCAACAGGAGCTAGCGGCAGTAGAAC

AGGAGATTGATCAGCGTAACCAAGACCGTCCGCTAGCCTACACGTATCTGAAGCCTTCGGAAATTATCAATAG

CATTAATACCTGA

7. Coding sequences (start codon changed with ATG) and the amino acid sequences mined from NCBI Coding sequence for WP_108935963.1

SEQ ID NO: 75

ATGGTTAATACCCCTCCTCCCACTCCTTGTCTGCCCCAAAATGAACCAGATGCGAATCGCCGGGCTGATTCCCT

CAATCTTCAACGGCAAGCCTATAGATACGACTATCAGTATCTCCCACCTTTAGTCCTCATGGAATCCGTGCCTG

CAGCGGAAAACTTTTCCCTTCAGTACATTACTGAACGGTTGGCGGCAACTGCGGAACTACCAGCCAATATGCT

GGCTGTCAAAGTCAAATCTTTTTTAGATCCCCTCGATGAGCTACAAGATTATGAGGACTTCTTTGCTATTATCCC

CTTACCCAAAATCGCCAAAGTCTATCAAACCAATGATGCCTTTGCCGAACAACGTCTATCGGGAGCTAATCCCC

TAGTATTACGTTTACTGAAGCCGGGGGATGCTGGCGCCCAAGTTCTCAATCAAATCCCCAGTTCTAAGACAGA

CTTCGAGCCATTGTTTCAGGTAAATCAAGAATTAGCGGCAGGAAACATTTACATTGCCGATTATACGGGTACG

GATGCTAATTATCTCGGTCCCTCTTTTGTTCAAGGGGGAACCCATGCCAAAGGGCGAAAATATTTACCGAAAC

CCAGGGCCTTCTTTTGGTGGCGGAAAAGTGGCATCAGAGATCGGGGCAAATTAGTTCCGATCGCTATCCAATT

TGGGGAAAATGCGGAAAAGCTTTATACTCCTTTTGAGAAAAACCCCCTTGCTTGGCTATTTGCTAAAATTTGTG

TTCAGGTGGCCGATAGCAATCACCACGAGATGAATTCCCATCTCTGTCGAACTCATTTTGTCATGGAACCGATC

GCGATCGGCACAGCCCGGCAACTGGCAGAAAATCATCCCCTCAGCCTTCTGCTTAAGCCACACCTAAGATTTA

TGTTAACGAACAACCATCTGGGACAAGAGAGACTGATCAACCCTGGTGGACCGGTGGATGAATTATTGGCCG

GCACCTTGGGCGAGTCGATGGCACTGGTTAAGGATGCCTACGCAAACTGGAATCTTCGAGACTTTGCCTTTCC

CAAAGAAATAAGTAACCGGGGTATGGATGATACGGAACGACTACCCCACTACCCTTACCGGGATGATGGGAT

GCTGGTTTGGCAGTCTATTAATCAGTTTGTTTCTGATTATCTCCATTATTTTTACCCAAACCCCCAAGACATCACT

AACGATCAAGAATTACAAGCATGGGCCAGAGAATTATCTAATTCTGCGGCAGATCAAGGGGGCAATGTGAAG

GGAATGCCAGCCAATTTTACGGATGTAGAGGACTTAATTGAAGTCGTTACCACAATTATTTTTATCTGCGGGCC

ACTGCATTCGGCCGTCAACTATGGTCAGTATGATTACATGACTTTTGCCGCTAATATGCCCTTGGCCGCTTACT

GTGATCTTCCAGAAGCGATTAAGGATACTACAGGATCAATAATTGGAGATGCCAGAGGATCAATTACCGAAA

AAGACATTCTTCAGCTATTGCCTCCTTATAAAAAGGCTGCCGATCAGTTACAAAGTCTGTTCACTTTATCCGACT

ATCGATACGATCGATTGGGCTATTACGATAAAGCTTTTCGAGAACTCTATGGACGGAAGTTTGAGGAGGTTTT

TGCCGAGGGTGATCAGGCAACAATTACGGGCTTCCTTCGACAATTTCAGCAAAATCTCAATATGAACGAACAA

GAGATTGATGCCAATAATCAAAAACGGATCGTACCCTATACCTATCTAAAACCTTCTCTAATACTCAATAGCAT

CAGCATTTAA

Amino acid Sequence for WP_108935963.1

SEQ ID NO: 76

MVNTPPPTPCLPQNEPDANRRADSLNLQRQAYRYDYQYLPPLVLMESVPAAENFSLQYITERLAATAELPANMLA

VKVKSFLDPLDELQDYEDFFAIIPLPKIAKVYQTNDAFAEQRLSGANPLVLRLLKPGDAGAQVLNQIPSSKTDFEPLFQ

VNQELAAGNIYIADYTGTDANYLGPSFVQGGTHAKGRKYLPKPRAFFWWRKSGIRDRGKLVPIAIQFGENAEKLYT

-continued

PFEKNPLAWLFAKICVQVADSNHHEMNSHLCRTHFVMEPIAIGTARQLAENHPLSLLLKPHLRFMLTNNHLGQER

LINPGGPVDELLAGTLGESMALVKDAYANWNLRDFAFPKEISNRGMDDTERLPHYPYRDDGMLVWQSINQFVSD

YLHYFYPNPQDITNDQELQAWARELSNSAADQGGNVKGMPANFTDVEDLIEVVTTIIFICGPLHSAVNYGQYDYM

TFAANMPLAAYCDLPEAIKDTTGSIIGDARGSITEKDILQLLPPYKKAADQLQSLFTLSDYRYDRLGYYDKAFRELYGR

KFEEVFAEGDQATITGFLRQFQQNLNMNEQEIDANNQKRIVPYTYLKPSLILNSISI

Coding sequence for WP_110985169.1

SEQ ID NO: 77

ATGCCCAGCCTGCCTCAGAACGATCCCGACCTACAAGCGCGTCAAGCTCTACTCAAGCAGCAGCAGGAGCGCT

ATCAATTTAACTTCGAGTATCTGGCACCGCTGGCCATGCTGGATGAAGTTCCCAAGGATGAGAATTTCTCCGG

CGCTTATCTTGCCGAACGTCTAACGCGCGCCGCTGATCTCCCGGTCAATATGTTGGCGGCGAAGGCTCATTCTC

TCTTAGATCCCCTAGATCGCCTGGAGGATTATGACGACTTGTTTACCTTGCTGCCTAAACCGGCTATTGCCAAT

ACATTCCAAACGGATGAAGTCTTTGCTGAACAGCGGTTGTCAGGAGCGAATCCAATGGCAATTCGCAGACTTG

ATCCCAGCAATCCGCCGTCGGCATATCTCAATATTAAGCAACAGCTAGCAACCAAGGGTAAAACGCTCGTCGA

GCGTAATCTTTACTACGTTGACTACAGCGAACTCAGCTTTATCCAGGGGGGAACCTACGCCAAGGGCAAAAAG

TACCTACCCACTCCCTTTGCTCTTTTTAGTTGGCAGTCAATGGGGTATCGCGATCACAAGACCAGCGATCATGG

CGAACTACTGCCCATTGCCATTCAGATTCAGCAAAACAACAGTGGTCGAGTCTATACGCCCCGAGATGCCCAT

CTTGACTGGTTATTTGCCAAACTCTGTGTCCAGATTGCTGACGGTAATCATCACGAGATGAGCAGCCATCTGTG

TCGCACTCATTTTGTTATGGAACCCATTGCCGTAGTCACTGCACGCCAACTGGCCGAAGATCACCCACTCTATA

TTTTACTGCAGCCTCACTTCCGATTTATGTTGGCCAACAACGAGCTGGGCCGGAAGCAGCTCATACAACACGG

TGGCCCGGTAGATAAGCTTTTGGCCGGGACGCTGGCCGAATCTTTGCAGGTTGTCAAAAATTCCTTTGAATCC

TGGAGCCTTGATCAGTTTTCCTTCCCCACCGAGGTTCGCAATCGCGGTATGGATAGCCCAGATCTGCCCCATTT

CCCTTACCGAGATGACGGCCAGCTCGTCTGGGATGCGATTTATAAATTTGTGACCGACTACCTGCGGCTCTTTT

ATGCTGACTCTGACGCTCTTAAAAACGATGAAGAGCTACAGAGCTGGCTTAAAGAACTGCGCGATCCGCAGG

GCGGACGCATCAAAGGCGTGCCCGAGCATATTCAAGCGCTAGAGCCGCTCGTTGAAATGGTGACCACCATTA

TTTTTACCTGTGGCCCGCAGCACTGTGCCGTCAACTATACCCAATATGAATATATGGCTCTGGCCTCCAACATTC

CCCTAGCGGCCTATCAAGATCTAACAGGTCTTGAAAACGGCTCCGAGACTAAACCTGCCATCACTGACGAAGC

CCACCTGATGCAGTATCTGCCGCCCTACCAGCAGGCTGCAGGACAGCTTCAAATCATGAATATTTTGACGGAC

TATCGCTATGACAAGTTGGGCTACTATGACCGCACCTTCAAGGATGCTTTTGCTGGAAGCAGTTTTGACACCGC

TGTTGATGCTGTTGTCGAGCAGTTCAAGCAGAATCTACGAGTCGTAGAGACTGAAATTGATCTCGATAACCGC

AAACGCGTGATTGAGTATCCCTACCTAAAGCCCTCTTTAATCTTGAATAGCATCAGTATCTAG

Amino acid Sequence for WP_110985169.1

SEQ ID NO: 78

MPSLPQNDPDLQARQALLKQQQERYQFNFEYLAPLAMLDEVPKDENFSGAYLAERLTRAADLPVNMLAAKAHSL

LDPLDRLEDYDDLFTLLPKPAIANTFQTDEVFAEQRLSGANPMAIRRLDPSNPPSAYLNIKQQLATKGKTLVERNLYY

VDYSELSFIQGGTYAKGKKYLPTPFALFSWQSMGYRDHKTSDHGELLPIAIQIQQNNSGRVYTPRDAHLDWLFAKL

CVQIADGNHHEMSSHLCRTHFVMEPIAVVTARQLAEDHPLYILLQPHFRFMLANNELGRKQLIQHGGPVDKLLAG

TLAESLQVVKNSFESWSLDQFSFPTEVRNRGMDSPDLPHFPYRDDGQLVWDAIYKFVTDYLRLFYADSDALKNDEE

LQSWLKELRDPQGGRIKGVPEHIQALEPLVEMVTTIIFTCGPQHCAVNYTQYEYMALASNIPLAAYQDLTGLENGS

ETKPAITDEAHLMQYLPPYQQAAGQLQIMNILTDYRYDKLGYYDRTFKDAFAGSSFDTAVDAVVEQFKQNLRVVE

TEIDLDNRKRVIEYPYLKPSLILNSISI

-continued

Coding sequence for WP_053540410.1

SEQ ID NO: 79

ATGCAGCCATTTCTACCTCAAAATGACCCGAACCCGGCACAACGCCAATCTTCTCTAGAGAAAGGACGCAAAG
AGTATCAATTCATGTATGATTTTTTGCCGCCTATGGCGATGCTCAAAAGCGTACCTCCCGCAGAGAATTTTTCT
ACTAAGTATATTGCTGAACGGACATTAGAGGCAGCAGAACTTCCTCTAAATATGATGGCTGTTAAAACTCATG
CTATGTGGGATACTTTAGATGAATTGCAAGATTATGAGGACTTTTTCCCAGTTTTGCAAAAACCTAATGTGATG
AAAACCTATGAAACCGATGATTCCTTCGCCGAACAACGGCTTTGTGGGGTGAATCCAATGGTTTTACGTCAAA
TTAAGCAAATGCCAGCTAACTTTGCCTTTACCATCGAAGAATTACAGGATAAGTTTGGCAATTCTATTAATTTA
ATCGAAAGATTGGCCACAGGAAATCTATATGTCGCTGATTATAGATCCTTGGCGTTCATTCAAGGTGGCACTT
ATGCCAAAGGAAAAAAGTACCTACCAGCACCTCTAGCCTTTTTCTGTTGGCGCAGTTCGGGCTTTCAAGATCG
AGGCCAATTAGTACCTGTAGCCATTCAAATCAATCCCAAGGCAGGTAAAGTCAGCCCCTTGCTAACTCCTTTTG
ATGACCCTTTAACCTGGTTTTATGCTAAGTCCTGTGTGCAAATTGCTGATGGTAATCATCATGAAATGAGTAGC
CATTTATGCCGGACTCACCTGGTAATGGAACCCTTTGCTGTTGTCACCCCGCGTCAACTGGCTGAAAATCATCC
TCTGAGAATATTACTCAAACCCCATTTCCGGTTTATGTTGGCTAATAATGATTTAGCTCGCAAGCGTCTGGTTA
GTAGGGGCGGTTTTGTGGATGAATTATTAGCAGGAACTCTGCAAGAATCATTGCAAATTGTGGTAGATGCCTA
TAAAAGTTGGAGTCTAGACCAGTTTGCTCTACCTAGGGAACTCAAAAATCGCGGTGTAGATGATGTGAAAAAC
TTGCCACATTATCCTTATCGGGATGATGGAATTTTGTTATGGAATGCGATTAATAAGTTTGTATTTAACTATTTG
CAGCTTTATTACAAGAGTCCAGCAGACTTGAAAGCAGACGGAGAACTGCAAGCTTGGGCGCGGGAATTGGTG
GCTCAGGATGGTGGTAGAGTTAAGGGTATGAGCGACCGCATTGATACCCTAGAACAATTAGTTGAGATTGTT
ACTACTATCATATATATTTGTGGTCCGCAGCATTCGGCGGTTAATTTCTCCCAATATGAATACATGGGTTTTATT
CCTAATATGCCCCTAGCTGCTTATCAAGAAATTCAACAAAAGGGTGATATTGAAGACCGTCAAGCCCTGATAG
ATTTTCTACCACCAGCAAAGCCCACAAATACCCAATTATCAACTGTGTACATACTTTCAGACTATCGTTATGACA
GACTGGGATATTATGAAGAGGAAGAATTTACAGATCCAAATGCTGACCAAGTTGTGAATAAATTTCAGCAAG
AATTGAATGTGGTACAGAGAAAAATTGAATTGAATAATAAGGGACGTTTAGTAAATTACGAATATCTCCAACC
CAGACTTATTCTCAACAGTATTAGTATTTAA

Amino acid Sequence for WP_053540410.1

SEQ ID NO: 80

MQPFLPQNDPNPAQRQSSLEKGRKEYQFMYDFLPPMAMLKSVPPAENFSTKYIAERTLEAAELPLNMMAVKTHA
MWDTLDELQDYEDFFPVLQKPNVMKTYETDDSFAEQRLCGVNPMVLRQIKQMPANFAFTIEELQDKFGNSINLIE
RLATGNLYVADYRSLAFIQGGTYAKGKKYLPAPLAFFCWRSSGFQDRGQLVPVAIQINPKAGKVSPLLTPFDDPLTW
FYAKSCVQIADGNHHEMSSHLCRTHLVMEPFAVVTPRQLAENHPLRILLKPHFRFMLANNDLARKRLVSRGGFVD
ELLAGTLQESLQIVVDAYKSWSLDQFALPRELKNRGVDDVKNLPHYPYRDDGILLWNAINKFVFNYLQLYYKSPADL
KADGELQAWARELVAQDGGRVKGMSDRIDTLEQLVEIVTTIIYICGPQHSAVNFSQYEYMGFIPNMPLAAYQEIQ
QKGDIEDRQALIDFLPPAKPTNTQLSTVYILSDYRYDRLGYYEEEEFTDPNADQVVNKFQQELNVVQRKIELNNKGR
LVNYEYLQPRLILNSISI

Coding sequence for WP_035367771.1

SEQ ID NO: 81

ATGATCAATATTATGCAGCCATTTCTACCTCAAAATGACCCGAACCCCGCACAACGCCAATCTTGTCTAGAGAA
AGGCCGCAAAGAGTATCAATTCATGTATGATTTTTTGCCGCCTATGGCGATGCTCAAAAGCGTACCTCCCGCA
GAGAATTTTTCTACTAAGTATATTGCTGAACGGACATTAGAGGCAGCAGAACTTCCTCTAAATATGATGGCTGT
TAAAACTCATGCTATGTGGGATCCTTTAGATGAATTGCAAGATTATGAGGACTTTTTCCCAGTTTTGCAAAAAC
CTAATGTGATGAAAACCTATGAAACCGATGATTCCTTCGCCGAACAACGGCTTTGTGGAGTAAATCCGATGGT
TTTACGTCAAATTAAGCAAATGCCAGCTAACTTTGCCTTTACCATTGAAGAATTACAGGATAAGTTTGGCAGTT

-continued

CTATTAATTTAATTGAAAGATTGGCAACCGGAAATCTATATGTCGCTGATTATAGATCCTTGGCGTTCATTCAA

GGTGGCACTTATGCCAAAGGAAAAAAGTACCTACCAGCACCTCTAGCTTTTTTCTGTTGGCGCACTTCAGGCTT

TCAAGATCGAGGCCAATTAGTACCTGTAGCCATTCAAATCGCCCCCAAAGCAGGTAAAGTCAGCCCCTTGCTA

ACTCCTTTTGATGACCCTTTAACCTGGTTTTATGCTAAGTCCTGTGTGCAAATTGCTGATGCTAATCATCATGAA

ATGAGCAGCCATTTATGCCGGACTCACCTGGTAATGGAACCCTTTGCTGTTGTCACCCCCCGTCAACTGGCTGA

AAATCATCCTCTGAGAATATTACTCAAACCCCATTTCCGGTTTATGTTGGCTAATAATGATTTAGCTCGCAAGC

GTCTGGTTAGTAGGGGCGGTTTTGTGGATGAATTATTAGCAGGAACTCTGCAAGAATCATTGCAAATTGTGGT

AGATGCCTATAAAAGTTGGAGTCTAGACCAGTTTGCTCTACCCAGAGAACTCAAAAATCGCGGTGTGAATGAT

GTCAAAAACTTACCACATTATCCTTATCGGGATGATGGAATTTTGTTATGGAATGCGATTAATAAGTTTGTATT

TAACTATTTGCAGCTTTATTATCAGAGTTCAGCAGACTTGAAAGCAGACGCAGAACTGCAAGCTTGGGCGCGG

GAATTAGTGGCTCAGGATGGTGGTAGAGTTAAGGGTATGAGCGATCGCATTGATACCCTAGAACAATTAGTG

GAGATTGTTACTACTATCATATATATTTGTGGTCCGCAGCATTCGGCGGTTAATTTCTCCCAATATGAATACATG

GGTTTTATTCCTAATATGCCCCTAGCTGCTTATCAACCAATTCAACAAAAGGGTGATATTAAAGACCGTAAAGC

CCTCATAGATTTTCTACCACCAGCCAAGCCCACAAATACCCAATTATCAACTGTGTACATACTTTCAGACTATCG

TTATGACAGACTGGGATATTATGAAGAGGAAGAATTTACAGATCCAAATGCTGACCAAGTTGTGAATAAATTT

CAGCAAGAATTGAATATGGTACAGAGAAAAATTGAATTGAATAATAAGGGACGTTTAGTAAATTACGAATATC

TCCAACCAAGACTTATTCTCAACAGTATTAGTATTTAA

Amino acid Sequence for WP_035367771.1

SEQ ID NO: 82

MINIMQPFLPQNDPNPAQRQSCLEKGRKEYQFMYDFLPPMAMLKSVPPAENFSTKYIAERTLEAAELPLNMMAV

KTHAMWDPLDELQDYEDFFPVLQKPNVMKTYETDDSFAEQRLCGVNPMVLRQIKQMPANFAFTIEELQDKFGSS

INLIERLATGNLYVADYRSLAFIQGGTYAKGKKYLPAPLAFFCWRTSGFQDRGQLVPVAIQIAPKAGKVSPLLTPFDD

PLTWFYAKSCVQIADANHHEMSSHLCRTHLVMEPFAVVTPRQLAENHPLRILLKPHFRFMLANNDLARKRLVSRG

GFVDELLAGTLQESLQIVVDAYKSWSLDQFALPRELKNRGVNDVKNLPHYPYRDDGILLWNAINKFVFNYLQLYYQ

SSADLKADAELQAWARELVAQDGGRVKGMSDRIDTLEQLVEIVTTIIYICGPQHSAVNFSQYEYMGFIPNMPLAAY

QPIQQKGDIKDRKALIDFLPPAKPTNTQLSTVYILSDYRYDRLGYYEEEEFTDPNADQVVNKFQQELNMVQRKIELN

NKGRLVNYEYLQPRLILNSISI

Coding sequence for OBQ35765.1

SEQ ID NO: 83

ATGAAGCCATTCCTACCTCAAAATGACCCGAACCCCGGACAACGCCAATCTTCTCTAGAGAAAGGCCGCAAAG

AGTATCAATTCATGTATGATTTTTTGCCTCCTATGGCGATGCTCAAAAGCGTACCTCCGGCAGAGAATTTTTCTA

CTAAGTATATTGCTGAACGGACATTAGAGGTAGCAGAACTTCCTCTGAATATGATGGCTGTTAAAACTCATGC

TATGTGGGATCCTTTAGATGAATTGCAAGATTATGAGGACTTTTTCCCAGTTTTGCAGAAACCTAATGTGATGA

AAACCTATGAAACTGATGATTCCTTTGCCGAACAACGGCTTTGTGGGGTAAATCCGATGGTTTTACGTCAAATT

AAGCAAATGCCAGCTAACTTTGCCTTTACCATCGAAGAATTACAGGATAAGTTTGGCAATTCTATTAATTTAAT

CGAAAGACTGGCAACGGGAAATCTATATGTCGCTGATTATAGATCCTTGGCGTTCGTTCAAGGTGGCACTTAT

GCCAAAGGGAAAAAGTACCTACCAGCACCTCTAGCTTTTTTCTGTTGGCGCAGTTCAGGCTTTCAAGATCGAG

GCCAATTAGTCCCTGTAGCCATTCAAATCAATCCCAAGGCAGGTAAGGTCAGCCCCTTGCTAACTCCTTTTGAT

GATCCTTTAACCTGGTTTTATGCTAAGTCCTGTGTACAAATTGCTGATGCTAATCATCATGAAATGAGTAGCCA

TTTATGCCGGACTCACCTGGTAATGGAACCCCTTTGCTGTTGTCACCCCGCGTCAACTGGCTGAAAATCATCCTC

TGAGAATATTACTCAAACCCCATTTCCGGTTTATGTTGGCTAATAATGATTTAGCTCGCAAGCGTCTGGTTAGT

CGGGGCGGTTTTGTGGATGAATTATTAGCAGGAACTCTGCAAGAATCATTGCAAATTGTGGTAGATGCCTATA

AAAGTTGGAGTCTAGACCAGTTTGCTCTACCCAGAGAACTCAAAAATCGCGGTGTAGATGATGTGAAAAACTT

-continued

GCCACATTATCCTTATCGGGATGATGGAATTTTGTTATGGAATGCGATTAATAAGTTTGTATTTAACTATTTGCA

GCTTTATTATCGAAGTTCAGCAGACTTGAAAGCAGACGGAGAACTGCAAGCTTGGGCGCGGGAATTGGTGGC

TCAGGATGGTGGTAGAGTTAAGGGTATGAGCGATCGCATTGATACCTTAGAACAATTAGTGGAGATTGTTACT

ACTATCATATATATTTGTGGTCCTCAGCATTCGGCGGTTAATTTCTCCCAATATGAATACATGGGTTTTATTCCT

AATATGCCCCTAGCTGCTTATCAAGCAATTCAACAAAAGGGTGATATTAAAGACCGTCAAGCCCTGATAGATT

TTCTACCACCAGCAAAGCCCACAAATACCCAATTATCAACTGTGTACATACTTTCAGACTATCGTTATGACAGA

CTGGGATATTATGAAGAGGAAGAATTTACAGATCCAAATGCTGACCAAGTTGTGAATAAATTTCAGCAAGAAT

TGAATGTGGTACAGAGAAAAATTGAATTGAATAATAAGGGACGTTTAGTAAATTATGAATATCTCCAACCAAG

ACTTATTCTCAACAGTATTAGTATTTAA

Amino acid Sequence for OBQ35765.1

SEQ ID NO: 84

MKPFLPQNDPNPGQRQSSLEKGRKEYQFMYDFLPPMAMLKSVPPAENFSTKYIAERTLEVAELPLNMMAVKTHA

MWDPLDELQDYEDFFPVLQKPNVMKTYETDDSFAEQRLCGVNPMVLRQIKQMPANFAFTIEELQDKFGNSINLIE

RLATGNLYVADYRSLAFVQGGTYAKGKKYLPAPLAFFCWRSSGFQDRGQLVPVAIQINPKAGKVSPLLTPFDDPLT

WFYAKSCVQIADANHHEMSSHLCRTHLVMEPFAVVTPRQLAENHPLRILLKPHFRFMLANNDLARKRLVSRGGFV

DELLAGTLQESLQIVVDAYKSWSLDQFALPRELKNRGVDDVKNLPHYPYRDDGILLWNAINKFVFNYLQLYYRSSAD

LKADGELQAWARELVAQDGGRVKGMSDRIDTLEQLVEIVTTIIYICGPQHSAVNFSQYEYMGFIPNMPLAAYQAIQ

QKGDIKDRQALIDFLPPAKPTNTQLSTVYILSDYRYDRLGYYEEEEFTDPNADQVVNKFQQELNVVQRKIELNNKGR

LVNYEYLQPRLILNSISI

Coding sequence for OBQ09764.1

SEQ ID NO: 85

ATGCAGCCATTTCTACCTCAAAATGACCCGAACCCCGCACAACGCCAATCTTGTCTAGAGAAAGGCCGCAAAG

AGTATCAATTCATGTATGATTTTTTGCCTCCTATGGCGATGCTCAAAAGCGTACCTCCCGCAGAGAATTTCTCTA

CTAAGTATATTGCTGAACGGACATTAGAGGCAGCAGAACTTCCTCTGAATATGATGGCTGTTAAAACTCATGC

TATGTGGGATCCTTTAGATGAATTGCAAGATTATGAGGACTTTTTCCCAATTTTGCAAAAACCTAATGTGATGA

AAACCTATGAAACCGATGATTCTTTCGCGGAACAACGGCTTTGTGGGGTAAATCCGATGGTTTTACGTCAAAT

TAAGCAAATGCCAGCTAACTTTGCCTTTACCATCGAAGAATTACAGGCTAAGTTTGGCAATTCTATTAATTTAA

TCGAAAGATTGGCAACAGGAAATCTATATGTCGCTGATTATAGATCCTTGGCGTTCGTTCAAGGTGGCACTTA

TGCCAAAGGAAAAAAGTACCTACCAGCACCTCTAGCCTTTTTCTGTTGGCGCAGTTCAGGCTTTCAAGATCGA

GGCCAATTAGTCCCTGTAGCCATTCAAATCAATCCCAAGGCAGGTAAAGCCAGCCCCTTGCTAACTCCTTTTGA

TGACCCTTTAACCTGGTTTTATGCTAAGTCCTGTGTGCAAATTGCTGATGGTAATCATCATGAAATGAGCAGCC

ATTTATGCCGGACTCACTTTGTCATGGAACCCTTTGCGGTTGTTACCCCTCGTCAACTGGCTGAAAATCATCCTC

TGAGAATATTACTCAAACCCCATTTCCGGTTCATGTTGGCTAACAATGATTTAGGTCGTCAGCGGCTGGTGAAT

AGGGGCGGTATTGTTGATGAATTATTAGCAGGAACTCTGCAAGAATCATTGCAAATTGTGGTAGATGCCTATA

AAAGTTGGAGTCTGGACCAGTTTGCTCTACCCAGAGAACTCAAAAATCGCGGTGTAGATGATGTGAAAAACTT

GCCACATTATCCTTATCGGGATGATGGAATTTTGTTATGGAATGCGATTAATAAGTTTGTATTTAACTATTTGCA

ACTTTATTACAAGAGTCCAGCAGACTTGAAAGCAGACGGAGAACTGCAAGCTTGGGCGCGGGAATTGGTGGC

TCAGGATGGTGGTAGAGTTAAGGGTATGAGCGATCGCATTGATACCTTAGAACAATTAGTTGAGATTATTACT

ACTATCATATATATTTGTGGTCCTCAGCATTCGGCGGTTAATTTCTCCCAATATGAATACATGGGTTTTATTCCT

AATATGCCCCTAGCTGCTTATCAAGAAATTCAACAAAAGGGTGATATTAAAGACCGTCAAGCCCTCATAGATTT

TCTACCACCAGCAAAGCCCACAAATACCCAATTATCAACTGTGTACATACTTTCAGACTATCGTTATGACAGAC

TGGGATATTATGAAGAGGAAGAATTTGCAGATCCAAATGCTGACCAAGTTGTGAATAAATTTCAGCAAGAATT

-continued

GAGTGTGGTACAGAGAAAAATTGAATTGAATAATAGGGGACGTTTAGTAAATTACGAATATCTCCAACCCGG

ACTTATTCTCAACAGTATTAGTATTTAA

Amino acid Sequence for OBQ09764.1

SEQ ID NO: 86

MQPFLPQNDPNPAQRQSCLEKGRKEYQFMYDFLPPMAMLKSVPPAENFSTKYIAERTLEAAELPLNMMAVKTHA

MWDPLDELQDYEDFFPILQKPNVMKTYETDDSFAEQRLCGVNPMVLRQIKQMPANFAFTIEELQAKFGNSINLIE

RLATGNLYVADYRSLAFVQGGTYAKGKKYLPAPLAFFCWRSSGFQDRGQLVPVAIQINPKAGKASPLLTPFDDPLT

WFYAKSCVQIADGNHHEMSSHLCRTHFVMEPFAVVTPRQLAENHPLRILLKPHFRFMLANNDLGRQRLVNRGGI

VDELLAGTLQESLQIVVDAYKSWSLDQFALPRELKNRGVDDVKNLPHYPYRDDGILLWNAINKFVFNYLQLYYKSPA

DLKADGELQAWARELVAQDGGRVKGMSDRIDTLEQLVEIITTIIYICGPQHSAVNFSQYEYMGFIPNMMPLAAYQEI

QQKGDIKDRQALIDFLPPAKPTNTQLSTVYILSDYRYDRLGYYEEEEFADPNADQVVNKFQQELSVVQRKIELNNRG

RLVNYEYLQPGLILNSISI

Coding sequence for OBQ23315.1

SEQ ID NO: 87

ATGCAGCCATTTCTACCTCAAAATGACCCGAACCCGGCACAACGCCAATCTTCTCTAGAGAAAGGACGCAAAG

AGTATCAATTCATGTATGATTTTTTGCCGCCTATGGCGATGCTCAAAAGCGTACCTCCCGCAGAGAATTTTTCT

ACTAAGTATATTGCTGAACGGACATTAGAGGCAGCAGAACTTCCTCTAAATATGATGGCTGTTAAAACTCATG

CTATGTGGGATACTTTAGATGAATTGCAAGATTATGAGGACTTTTTCCCAGTTTTGCAAAAACCTAATGTGATG

AAAACCTATGAAACCGATGATTCCTTCGCCGAACAACGGCTTTGTGGGGTGAATCCAATGGTTTTACGTCAAA

TTAAGCAAATGCCAGCTAACTTTGCCTTTACCATCGAAGAATTACAGGATAAGTTTGGCAATTCTATTAATTTA

ATCGAAAGATTGGCCACAGGAAATCTATATGTCGCTGATTATAGATCCTTGGCGTTCATTCAAGGTGGCACTT

ATGCCAAAGGAAAAAAGTACCTACCAGCACCTCTAGCCTTTTTCTGTTGGCGCAGTTCGGGCTTTCAAGATCG

AGGCCAATTAGTACCTGTAGCCATTCAAATCAATCCCAAGGCAGGTAAAGTCAGCCCCTTGCTAACTCCTTTTG

ATGACCCTTTAACCTGGTTTTATGCTAAGTCCTGTGTGCAAATTGCTGATGCTAATCATCATGAAATGAACAGC

CATTTATGCCGGACTCACCTGGTAATGGAACCCTTTGCTGTTGTCACCCCGCGTCAACTGGCTGAAAATCATCC

TCTGAGAATATTACTCAGACCCCATTTCCGGTTTATGTTGGCTAATAATGATTTAGCTCGCAAGCGTCTGGTTA

GTAGGGGCGGTTTTGTGGATGAATTATTAGCAGGAACTCTGCAAGAATCATTGCAAATTGTGGTAGATGCCTA

TAAAAGTTGGAGTCTAGACCAGTTTGCTCTACCTAGGGAACTCAAAAATCGCGGTGTAGATGATGTGAAAAAC

TTGCCACATTATCCTTATCGGGATGATGGAATTTTGTTATGGAATGCGATTAATAAGTTTGTATTTAACTATTTG

CAGCTTTATTATAAGAGTTCAGCAGACTTGAAAGCAGACGGAGAACTGCAAGCTTGGGCGCGGGAACTAGTG

GCTCAGGATGGTGGTAGGGTTAAGGGTATGAGCGATCGCATTGATACCCTAGAACAATTAGTTGAGATTGTT

ACTACTATCATATATATTTGTGGTCCGCAGCATTCGGCGGTTAATTTCTCCCAATATGAATACATGGGTTTTATT

CCTAATATGCCCCTAGCTGCTTATCAAGCAATTCAACAAAAGGGTGATATTAAAGACCGTCAAGCCCTCATAGA

TTTTCTACCACCTGCCAAGCCCACAAATACCCAATTATCAACTGTGTACATACTTTCAGACTATCGTTATGACAG

ACTGGGATATTATGAAGAGGAAGAATTTACAGATCGAAATGCTGACCAAGTTGTGAATAAATTTCAGCAAGA

ATTGAATGTGGTACAGAGAAAAATTGAATTGAATAATAAGGGACGTTTAGTAAATTACGAATATCTCCAACCC

AGACTTATTCTCAACAGTATTAGTATTTAA

Amino acid Sequence for OBQ23315.1

SEQ ID NO: 88

MQPFLPQNDPNPAQRQSSLEKGRKEYQFMYDFLPPMAMLKSVPPAENFSTKYIAERTLEAAELPLNMMAVKTHA

MWDTLDELQDYEDFFPVLQKPNVMKTYETDDSFAEQRLCGVNPMVLRQIKQMPANFAFTIEELQDKFGNSINLIE

RLATGNLYVADYRSLAFIQGGTYAKGKKYLPAPLAFFCWRSSGFQDRGQLVPVAIQINPKAGKVSPLLTPFDDPLTW

FYAKSCVQIADANHHEMNSHLCRTHLVMEPFAVVTPRQLAENHPLRILLRPHFRFMLANNDLARKRLVSRGGFVD

ELLAGTLQESLQIVVDAYKSWSLDQFALPRELKNRGVDDVKNLPHYPYRDDGILLWNAINKFVFNYLQLYYKSSADL

-continued

KADGELQAWARELVAQDGGRVKGMSDRIDTLEQLVEIVTTIIYICGPQHSAVNFSQYEYMGFIPNMPLAAYQAIQ
QKGDIKDRQALIDFLPPAKPTNTQLSTVYILSDYRYDRLGYYEEEEFTDRNADQVVNKFQQELNVVQRKIELNNKGR
LVNYEYLQPRLILNSISI

Coding sequence for OBQ30848.1

SEQ ID NO: 89

ATGCAGCCATTTCTACCTCAAAATGACCCAAACCCGGCACAACGCCAATCTTGTCTAGAGAAAGGCCGCAAAG
AGTATAAATTCATGTATGATTTTTTGCCGCCTATGGCAATGATCAAAAGCGTACCTCCCGCAGAGAATTTTTCT
ACTAAGTATATTGCTGAACGGACATTAGAGGCGGCAGAACTTCCTCTAAATATGATGGCTGTTAAAACTCATG
CTATGTGGGATCCTTTAGATGAATTGCAAGATTATGAGGACTTTTTCCCAGTTTTGCAAAAACCTAATGTGATG
AAAACCTATGAAACCGATGATTCCTTCGCCGAACAACGGCTCTGTGGGGTAAATCCGATGGTTTTACGTCAAA
TTAAGCAAATGCCAGCTAACTTTGCCTTTACCATCGAAGAATTACAGGATAAGTTTGGCAATTCTATTAATTTA
ATCGAAAGATTGGCCACAGGAAATCTATATGTCGCTGATTATAGATCCTTGGCGTTCGTTCAAGGTGGCACTT
ATGCCAAAGGGAAAAAGTACCTACCAGCACCTCTAGCTTTTTTCTGTTGGCGCAGTTCAGGCTTTCAAGATCGA
GGCCAATTAGTCCCTGTAGCCATTCAAATCAATCCCAAGGCAGGTAAGGTCAGCCCCTTGCTGACTCCTTTTGA
TGACCCTTTAACCTGGTTTTATGCTAAGTCCTGTGTACAAATTGCTGATGCTAATCATCATGAAATGAGTAGCC
ATTTATGCCGGACTCACCTGGTAATGGAACCCTTTGCTGTTGTCACCCCGCGTCAACTGGCTGAAAATCATCCT
CTGAGAATATTACTCAAACCCCATTTCCGGTTTATGTTGGCTAATAATGATTTAGCTCGCAAGCGTCTGGTTAG
TCGGGGCGGTTTTGTGGATGAATTATTAGCAGGAACTCTGCAAGAATCATTGCAAATTGTGGTAGATGCCTAT
AAAAGTTGGAGTCTGGACCAGTTTGCTCTACCCAGGGAACTCAAAAATCGCGGTGTAGATGATGTGAAAAAC
TTGCCACATTATCCTTATCGGGATGATGGAATTTTGTTATGGAATGCGATTAATAAGTTTGTATTTAACTATTTG
CAGCTTTATTACAAGAGTCCAGCAGACTTGAAAGCAGACGGAGAACTGCAAGCTTGGGCGCGGGAATTGGTG
GCTCAGGATGGTGGTAGAGTTAAGGGTATGAGCGATCGCATTGATACCTTAGAACAATTAGTTGAGATTGTTA
CTACTATCATATATATTTGTGGTCCGCAGCATTCGGCGGTTAATTTCTCCCAATATGAATACATGGGTTTTATTC
CTAATATGCCCCTAGCTGCTTATCAAGAAATTCAACAAAAGGGTGATATTAAAGACCGTCAAGCCCTCATAGAT
TTTCTACCACCAGCAAAGCCCACAAATACCCAATTATCAACTGTGTACATACTTTCAGACTATCGTTATGACAG
ACTGGGATATTATGAAGAGGAAGAATTTACAGATCCAAATGCTGACCAAGTTGTGAATAAATTTCAGCAAGAA
TTGAATGTGGTACAGAGAAAAATTGAATTGAATAATAAGGGACGTTTAGTAAATTATGAATATCTCCAACCAA
GACTTATTCTCAACAGTATTAGTATTTAA

Amino acid Sequence for OBQ30848.1

SEQ ID NO: 90

MQPFLPQNDPNPAQRQSCLEKGRKEYKFMYDFLPPMAMIKSVPPAENFSTKYIAERTLEAAELPLNMMAVKTHA
MWDPLDELQDYEDFFPVLQKPNVMKTYETDDSFAEQRLCGVNPMVLRQIKQMPANFAFTIEELQDKFGNSINLIE
RLATGNLYVADYRSLAFVQGGTYAKGKKYLPAPLAFFCWRSSGFQDRGQLVPVAIQINPKAGKVSPLLTPFDDPLT
WFYAKSCVQIADANHHEMSSHLCRTHLVMEPFAVVTPRQLAENHPLRILLKPHFRFMLANNDLARKRLVSRGGFV
DELLAGTLQESLQIVVDAYKSWSLDQFALPRELKNRGVDDVKNLPHYPYRDDGILLWNAINKFVFNYLQLYYKSPA
DLKADGELQAWARELVAQDGGRVKGMSDRIDTLEQLVEIVTTIIYICGPQHSAVNFSQYEYMGFIPNMPLAAYQEI
QQKGDIKDRQALIDFLPPAKPTNTQLSTVYILSDYRYDRLGYYEEEEFTDPNADQVVNKFQQELNVVQRKIELNNKG
RLVNYEYLQPRLILNSISI

Coding sequence for OBQ23778.1

SEQ ID NO: 91

ATGCAGCCATTTCTACCTCAAAATGACCCAAACCCCGCACAACGCCAATCTTCTCTAGAGAAAGGCCGCAAAG
AGTATCAATTCATGTATGATTTTTTGCCGCCTATGGCGATGCTCAAAAGCGTACCTCCCGCAGAGAATTTTTCT
ACTAAGTATATTGCTGAACGGACATTAGAGGCAGCAGAACTTCCTCTAAATATGATGGCTGTTAAAACTCATG

-continued

CTATGTGGGATCCTTTAGATGAATTGCAAGATTATGAAGACTTTTTCCCAGTTTTGCAAAAACCTAATGTGATG
AAAACCTATGAAACCGATGATTCCTTCGCCGAACAACGGCTTTGTGGGGTGAATCCGATGGTTTTACGTCAAA
TTAAGCAAATGCCAGCTAACTTTGCCTTTACCATTGAAGAATTACAGGATAAGTTTGGCAATTCTATTAATTTA
ATCGAAAGATTGGCCACAGGAAATCTATATGTCGCTGATTATAGATCCTTGGCGTTCATTCAAGGTGGCACTT
ATGCCAAAGGAAAAAAGTACCTACCAGCACCTCTGGCCTTTTTCTGTTGGCGCAGTTCGGGCTTTCAAGATCG
AGGCCAATTAGTCCCTGTAGCCATTCAAATCAATCCCAAAGCAGGTAAAGCCAGCCCCTTGCTGACTCCTTTTG
ATGACCCTTTAACCTGGTTTTATGCTAAGTCCTGTGTGCAAATTGCTGATGGTAATCATCATGAAATGAGTAGC
CATTTATGTCGGACTCACTTAGTAATGGAACCCTTTGCTGTTGTCACCCCGCGTCAACTGGCTGAAAATCATCC
TCTGAGAATATTACTCAGACCCCATTTCCGGTTTATGTTGGCTAATAATGATTTAGCCCGCAAGCGTCTGGTTA
GTAGGGGCGGTTTTGTTGATGAATTATTAGCAGGAACTCTGCAAGAATCATTGCAAATTGTGGTAGATGCCTA
TAAAAGTTGGAGTCTGGACCAGTTTGCTCTACCCAGGGAACTCAAAAATCGCGGTGTAGATGATGTGAAAAA
CTTGCCACATTATCCTTATCGGGATGATGGAATTTTGTTATGGAATGCGATTAATAAGTTTGTATTTAACTATTT
GCAACTTTATTACAAGAGTCCAGCAGACTTGAAAGCAGACGGAGAACTACAAGCTTGGGCGCGGGAATTGGT
GGCTCAGGATGGTGGTAGAGTTAAGGGTATGAGCGATCGCATTGATACCTTAGAACAATTAGTTGAGATTGT
TACTACTATCATATATATTTGTGGTCCGCAGCATTCGGCGGTTAATTTCTCCCAATATGAATACATGGGTTTTAT
TCCTAATATGCCCCTAGCTGCTTATCAAGCAATTCAAGAAAAGGGTGATATTAAAGACCGTCAAGCCCTCATA
GATTTTCTACCACTTGCCAAACCCACAAATACCCAATTATCAACTGTGTACATACTTTCAGACTATCGTTATGAC
AGACTGGGATATTATGAAGAGGAAGAATTTACAGATCCAAATGCTGACCAAGTTGTGAATAAATTTCAGCAA
GAATTGAGTGTGGTACAGAGAAAAATTGAATTGAATAATAAGGGACGTTTAGTAAATTACGAATATCTCCAAC
CCAGACTTATTCTCAACAGTATTAGTATTTAA

Amino acid Sequence for OBQ23778.1

SEQ ID NO: 92

MQPFLPQNDPNPAQRQSSLEKGRKEYQFMYDFLPPMAMLKSVPPAENFSTKYIAERTLEAAELPLNMMAVKTHA
MWDPLDELQDYEDFFPVLQKPNVMKTYETDDSFAEQRLCGVNPMVLRQIKQMPANFAFTIEELQDKFGNSINLIE
RLATGNLYVADYRSLAFIQGGTYAKGKKYLPAPLAFFCWRSSGFQDRGQLVPVAIQINPKAGKASPLLTPFDDPLT
WFYAKSCVQIADGNHHEMSSHLCRTHLVMEPFAVVTPRQLAENHPLRILLRPHFRFMLANNDLARKRLVSRGGFV
DELLAGTLQESLQIVVDAYKSWSLDQFALPRELKNRGVDDVKNLPHYPYRDDGILLWNAINKFVFNYLQLYYKSPA
DLKADGELQAWARELVAQDGGRVKGMSDRIDTLEQLVEIVTTIIYICGPQHSAVNFSQYEYMGFIPNMPLAAYQAI
QEKGDIKDRQALIDFLPLAKPTNTQLSTVYILSDYRYDRLGYYEEEEFTDPNADQVVNKFQQELSVVQRKIELNNKGR
LVNYEYLQPRLILNSISI

Coding sequence for WP_015083575.1

SEQ ID NO: 93

ATGCAGCCATTTCTACCTCAAAATGACCCGAACCCCGCACAACGCCAATCTTGTCTAGAGAAAGGCCGCAAAG
AGTATCAATTCATGTATGATTTTTTGCCGCCTATGGCGATGCTCAAAAGCGTACCTCCCGCAGAGAATTTTTCT
ACTAAGTATATTGCTGAACGGACATTAGAGGCAGCAGAACTTCCTCTAAATATGATGGCTGTTAAAACTCATG
CTATGTGGGATCCTTTAGATGAATTGCAAGATTATGAGGACTTTTTCCCAGTTTTGCAAAAACCTAATGTGATG
AAAACCTATGAAACCGATGATTCCTTCGCCGAACAACGGCTTTGTGGGGTGAATCCGATGGTTTTACGTCAAA
TTAAGCAAATGCCAGCTAACTTTGCCTTTACCATTGAAGAATTACAGGATAAGTTTGGCAATTCTATTAATTTA
ATCGAAAGATTGGCCACAGGAAATCTATATGTCGCTGATTATAGATCCTTGGCGTTCGTTCAAGGTGGCACTT
ATGCCAAAGGAAAAAAGTACCTACCAGCACCTCTGGCCTTTTTCTGTTGGCGCAGTTCGGGCTTTCAAGATCG
AGGCCAATTAGTCCCTGTAGCCATTCAAATCAATCCCAAAGCAGGTAAAGCCAGCCCCTTGCTAACTCCTTTTG
ATGACCCTTTAACCTGGTTTTATGCTAAGTCCTGTGTGCAAATTGCTGATGCTAATCATCATGAAATGAGCAGC
CATTTATGCCGGACTCACCTGGTAATGGAACCCTTTGCTGTTGTCACCCCGCGTCAACTGGCTGAAAATCATCC

-continued

TCTGAGAATATTACTCAGACCCCATTTCCGGTTTATGTTGGCTAATAATGATTTAGCTCGCAAGCGTCTGGTTA
GTAGGGGCGGTTTTGTGGATGAATTATTAGCAGGAACTCTGCAAGAATCATTGCAAATTGTGGTAGATGCCTA
TAAAAGTTGGAGTCTAGACCAGTTTGCTCTACCTAGGGAACTCAAAAATCGCGGTGTAGATGATGTGAAAAAC
TTGCCACATTATCCTTATCGGGATGATGGAATTTTGTTATGGAATGCGATTAATAAGTTTGTATTTAACTATTTG
CAGCTTTATTATAAGAGTCCAGCAGACTTGAAAGCAGACGGAGAACTGCAAGCTTGGGCGCGGGAATTAGTG
GCTCAGGATGGTGGTAGGGTTAAGGGTATGAGCGATCGCATTGATACCCTAGAACAATTAGTTGAGATTGTT
ACTACTATCATATATATTTGTGGTCCGCAGCATTCGGCAGTTAATTTCTCCCAATATGAATACATGGGTTTTATT
CCTAATATGCCCCTAGCTGCTTATCAAGAAATTCAACAAAAGGGTGATATTGAAGACCGTCAAGCCCTCATAG
ATTTTCTACCACCTGCCAAACCCACAAATACCCAATTATCAACTGTGTACATACTTTCAGACTATCGTTATGACA
GACTGGGATATTATGAAGAGGAAGAATTTGCAGATCCAAATGCTGACAAAGTTGTGAATAAATTCCAGCAAG
AATTGAGTGTGGTACAGAGAAAAATTGAATTGAATAATAAGGGACGTTTAGTAAATTATGAATATCTCCAACC
AAGACTCATTCTCAACAGTATTAGTATTTAA

Amino acid Sequence for WP_015083575.1

SEQ ID NO: 94

MQPFLPQNDPNPAQRQSCLEKGRKEYQFMYDFLPPMAMLKSVPPAENFSTKYIAERTLEAAELPLNMMAVKTHA
MWDPLDELQDYEDFFPVLQKPNVMKTYETDDSFAEQRLCGVNPMVLRQIKQMPANFAFTIEELQDKFGNSINLIE
RLATGNLYVADYRSLAFVQGGTYAKGKKYLPAPLAFFCWRSSGFQDRGQLVPVAIQINPKAGKASPLLTPFDDPLT
WFYAKSCVQIADANHHEMSSHLCRTHLVMEPFAVVTPRQLAENHPLRILLRPHFRFMLANNDLARKRLVSRGGFV
DELLAGTLQESLQIVVDAYKSWSLDQFALPRELKNRGVDDVKNLPHYPYRDDGILLWNAINKFVFNYLQLYYKSPA
DLKADGELQAWARELVAQDGGRVKGMSDRIDTLEQLVEIVTTIIYICGPQHSAVNFSQYEYMGFIPNMPLAAYQEI
QQKGDIEDRQALIDFLPPAKPTNTQLSTVYILSDYRYDRLGYYEEEEFADPNADKVVNKFQQELSVVQRKIELNNKG
RLVNYEYLQPRLILNSISI

Coding sequence for WP_027404620.1

SEQ ID NO: 95

ATGAAGCCATTTTTACCTCAAAATGACCCAAATCCCACACAACGACAATCTTCCCTAGAGAAAGGTCGCAAAG
AGTATGAATTTAGGTATGATTTTTTGCCTCCTATGGCGATGCTCAAAAACGTACCTCCCTCTGAGAATTTTTCTA
CCAAGTATATTGCTGAACGGACAATAGAGACAGCAGAACTTCCTAGCAATATGATGGCTGTCAAAGCCCATGC
TATGTGGGACCCCTTAGATGAATTGCAAGACTATGAAGACTTTTTTCCAGTTTTGCAAAAACCTAATGTGATGA
AAAATTATGAAACAGATGATTCCTTCGCCGAACAACGGCTTTGTGGCGTGAATCCTGTGGTTTTACGGCAGAT
TAAGCAAATGCCCGTCAACTTTGCCTTTACCATCGAAGAATTGCAAGCTAAGTTTGGCAACTCTATTGATTTAA
GAGAAAGACTGGCAACCGGAAATCTCTATGTAGCTGATTATAGACCTTTGGCGTTCATTCGAGGTGGCACTTT
TGCCAAAGGGAAAAAGTATTTACCAGCACCACTAGCCTTTTTCTGTTGGCGGAGTTCAGGCTTTCAAGATCGT
GGTCAATTAGTACCTATAGCGATTCAAATCAATCCTAAGGAAGGAAAAGCCAGCCCCTTGCTGACCCCTTTTG
ATGACTCTTCTACCTGGTTTTATGCCAAGTCCTGTGTGCAAATTGCTGATGCTAATCATCATGAAATGAGTAGC
CATTTATGCCGGACTCACTTTGTAATGGAACCTTTTGCTGTTGTTACCCCTCGTCAATTAGCCCAGAACCATCCG
CTGAGAATATTACTAAAACCCCATTTCCGGTTCATGTTGGCTAACAATGATTTAGGTCGTCAGCGGTTGGTGAA
TAGAGGCGGTCCTGTTGATGAATTATTAGCGGGAACTCTGCAAGAATCACTGCAAATTGTTCTAGACGCTTAT
ACAGATTGGAGATTGGATCAGTTTGCGCTACCAACAGAACTCAAAAATCGCGGTGTGGATGATGTGAAAAAT
TTGCCCCACTATCCTTATCGGGACGATGGGATCTTGTTGTGGAACGCGATTAACAAGTTTGTGTTTAACTATTT
GGAGCTTTACTACAAGAGTCCCGCAGACTTGACAGCAGATGTCGAACTACAAGCTTGGGCGCGGGAATTAGT
GGCTCAGGATGGTGGTAGAGTCAAGGGGATGAGCGATCGCATTGATACTTTGAAACAATTAGTAGAGATTGT
TACTACTATCATTTACACTTGTGGACCCCTGCATTCTGCTGTTAATTTCCCCCAATATGAATACATGGGTTTCATT

-continued

CCCAATATGCCTCTGGCTGCTTATCAACCAATTAAAAAAGAAGGGGTTTGTACCCGCAAGGAACTGATAGATT
TTTTACCAGCTGCCAAACCAACAAGTAGCCAATTAACAACTGTATTCACACTCTCAGCCTATCGTTATGACAGA
CTAGGATATTATGAAGAGGAAGAATTTGAAGACCCCAATGCTGACGATGTTGTGAATAAATTCCAGCAAGAAT
TGAATGTGGTGCAAAGAAAAATTGAGTTGAGCAACAAGGGACGTTTAGTAAATTACGAATACCTACAACCCA
GACTTATCCTCAACAGCATCAGTATTTAA

Amino acid Sequence for WP_027404620.1

SEQ ID NO: 96

MKPFLPQNDPNPTQRQSSLEKGRKEYEFRYDFLPPMAMLKNVPPSENFSTKYIAERTIETAELPSNMMAVKAHAM
WDPLDELQDYEDFFPVLQKPNVMKNYETDDSFAEQRLCGVNPVVLRQIKQMPVNFAFTIEELQAKFGNSIDLRER
LATGNLYVADYRPLAFIRGGTFAKGKKYLPAPLAFFCWRSSGFQDRGQLVPIAIQINPKEGKASPLLTPFDDSSTWFY
AKSCVQIADANHHEMSSHLCRTHFVMEPFAVVTPRQLAQNHPLRILLKPHFRFMLANNDLGRQRLVNRGGPVDE
LLAGTLQESLQIVLDAYTDWRLDQFALPTELKNRGVDDVKNLPHYPYRDDGILLWNAINKFVFNYLELYYKSPADLT
ADVELQAWARELVAQDGGRVKGMSDRIDTLKQLVEIVTTIIYTCGPLHSAVNFPQYEYMGFIPNMPLAAYQPIKKE
GVCTRKELIDFLPAAKPTSSQLTTVFTLSAYRYDRLGYYEEEEFEDPNADDVVNKFQQELNVVQRKIELSNKGRLVNY
EYLQPRLILNSISI

Coding sequence for WP_114084873.1

SEQ ID NO: 97

ATGAAACCATACCTTCCTCAAAATGATCCTGACCCTACAAAACGTAAAATATTGCTAGAGAGAAACCAAGGAG
AGTATGAATTTGATTACGACTTTTTAACGCCTATGGCAATGCTAAAAAATGTACCTTCTATAGAAAACTTTTCAA
CTAAGTATATTGCTGAACGCACATTAGAGACAGCAGAACTACCTATAAATATGTTAGCCGTTAAAACCCGTTCT
TTATGGGACCCTTTAGATGAATTGCAAGACTATGAAGACTATTTTCCAGTTTTGCCTAAACCTAATGTTATCAA
AACATACCAAACTGATGACTCTTTTTGTGAACAACGGCTTTGTGGGGCAAATCCTTTTGTTTTACGTCGAATTG
AAAAGATGCCAGATGGCTTCGCCTTTACCATTTTAGAACTGCAAGAAAAGTTTGGTGACTCTATTAACTTAGTT
GACAAACTTACGAATGGAAATTTATATGTAGCTGATTATAGAGCGCTTGCGTTTGTTAAAGGAGGTACTTATG
AAAGAGGTAAGAAGTATTTACCAACCCCTATAGCTTTCTTTTGTTGGCGCAGTTCTGGTTTTAGCGATCGCGGT
CAACTAGTACCGATTGTTATCCAAATCAACCCCACAGATGGCAAACAGAGCCAGCTAATTACGCCTTTTGATGA
CCCTTTAACCTGGTTTCATGCCAAACTTTGTGTTCAAATTGCTGATGCTAACCATCATGAAATGAGTAGTCATCT
GTGCCGAACTCACTTTGTTATGGAACCCTTTGCTATTGTCACAGCCCGTCAACTAGCCGAGAACCATCCCCTTA
GCTTACTGCTAAAACCCCACTTCCGTTTCATGTTGGCTAATAATGACTTGGCTCGTAAGCGCCTAATTAGTAGA
GGTGGGCCTGTTGACGAATTGCTAGCCGGAACTCTGCAAGAGTCATTGCAAATTGTCGTCAACGCATATCAAG
AATGGAGCTTAGATCAGTTTTCCTTACCCACTGAACTAAAAAATCGGGGTATGGATGACCCAAACAACCTACC
TCACTATCCCTATCGAGACGATGGCTTGCTATTGTGGAATGCAATTAAAAAGTTTGTGTCTGAATACTTGCAAA
TATACTACAAAACTCCCCAAGACTTAGCAGCAGACTTAGAATTACAAAGTTGGGCGCAGGAATTAGTTTCCCA
ATCAGGCGGGCGAGTTAAGGGTATTAGCAATCGCATCGACACATTAGACCAATTAGTTGATATTGCTACTGCG
GTTATTTTCACCTGTGGGCCGCAACACGCTGCTGTTAACTACTCACAATATGAATATATGACTTTCATGCCCAAT
ATGCCTCTTGCTGCTTATAAACAAATGACATCAGAAGGCACTATTCCTGACCGTAAAAGTCTATTATCATTTCTG
CCACCGTCAAAGCAAACTGCTGACCAATTATCGATTTTATTTATCCTGTCAGCTTACCGTTATGACAGATTAGG
GTACTATGATGATAAGTTTGTAGACCCAGAGGCTCAGGATGTTTTAGCTAAATTTCAGCAAGATTTGAACGAA
GCGGAGCGGGAAATTGAGTTGAATAACAAGAGTCGTTTAATAAATTACAACTATCTGAAACCACGGCTTGTTA
CTAATAGTATTAGCGTGTAA

Amino acid Sequence for WP_114084873.1

SEQ ID NO: 98

MKPYLPQNDPDPTKRKILLERNQGEYEFDYDFLTPMAMLKNVPSIENFSTKYIAERTLETAELPINMLAVKTRSLWD
PLDELQDYEDYFPVLPKPNVIKTYQTDDSFCEQRLCGANPFVLRRIEKMPDGFAFTILELQEKFGDSINLVDKLTNGN

-continued

LYVADYRALAFVKGGTYERGKKYLPTPIAFFCWRSSGFSDRGQLVPIVIQINPTDGKQSQLITPFDDPLTWFHAKLCV

QIADANHHEMSSHLCRTHFVMEPFAIVTARQLAENHPLSLLLKPHFRFMLANNDLARKRLISRGGPVDELLAGTLQ

ESLQIVVNAYQEWSLDQFSLPTELKNRGMDDPNNLPHYPYRDDGLLLWNAIKKFVSEYLQIYYKTPQDLAADLELQ

SWAQELVSQSGGRVKGISNRIDTLDQLVDIATAVIFTCGPQHAAVNYSQYEYMTFMPNMPLAAYKQMTSEGTIP

DRKSLLSFLPPSKQTADQLSILFILSAYRYDRLGYYDDKFVDPEAQDVLAKFQQDLNEAEREIELNNKSRLINYNYLKP

RLVTNSISV

Coding sequence for WP_096538768.1

SEQ ID NO: 99

ATGAAACCATACCTTCCTCAAAATGACCCCGACCCAACAAAACGCAAATCTTTCTTAGAGCGTAAGCAAGAAG

AATATGAATTCGATTATGATTTTTTACCGCCGATGGCGATGCTTAAAGATGTACCTGCCGTCGAAAATTTTTCT

ACAAAATATATTGCTGAACGTGCAGTAGAAACGGCAGAGCTTCCTATCAATATGTTGGCTGTTAAAACCCATA

CTTTATGGGACCCTTTGGATGAATTGCAAGACTATGAAGACTATTTTCCAGTCTTGCCTAAACCTACTGTCATCA

AAACATACCAAACTGATGACTCGTTTTGCGAACAACGGCTGTGTGGGTCAAATCCTATGGCTTTACGCCAAATT

AAAGAGATGCCTTTAGACTTTGAGTTTACTATTCAAGAATTACAACGAAAATTTGGCGAATCTATCAATTTGGC

AGAAAAACTTGCCAATGGAAATTTATATATAACCGATTACAGATCGCTTTCCTTTGTTAAAGGAGGCACTTACG

AAAGAGGTAGAAAGTATTTACCAACACCCTTAGCTTTTTTTTGTTGGCGTAGTTCTGGCTTTAGCGATCGCGGT

CAACTTGTACCTATTGCCATTCAACTCAATCCCGCAGCCGGTAAACAAAGCCAACTAATCACACCTTTTGACGA

TCCTTTAGCTTGGTTTCATGCCAAACTATGCGTTCAAATCGCTGATGCTAACCATCATGAAATGAGTAGCCATC

TTTGTCGAACTCACTTTGTTATGGAACCTTTCGCCATTGTCACAGCCCGTCAATTAGCTGATAATCATCCTCTTA

ATTTATTACTAAAACCGCACTTCCGTTTCATGTTGGCTAATAATGATTTGGGTCGCAAGCGCTTAGTTAATAGG

GGCGGCCCTGTTGATGAATTGCTAGCTGGAACTCTGCAAGAATCACTACAAATTGTTGTTAATGCCTATAAAG

AATGGAGCTTAGATAAGTTTGCCTTACCCACGGAAATCAAAAATCGTGGTGTAGACGATCCACAAAAAATTACC

TCACTATCCCTATCGAGATGATGGGATGCTATTGTGGAATGCCATTAAAAAGTTTGTGTCTGAATACTTGAATT

TATACTACAAAACTCCCGAAGATTTGACAGCAGACTTTGAATTACAAGCTTGGGCGCAGGAACTAGTTTCTCA

ATCAGGCGGACGAGTTAAAGGCGTTCCCGATCGCATTGAAAAATTAGAACAATTAATTGATATCGCTACTGCG

GTAATTTTCACTTGCGGGCCGCAACACGCTGCTGTGAACTATCCACAATATGAATATATGACTTTCATGCCGAA

TATGCCCCTTGCTGGTTATAAACAAATGACATCAGAAGGCACTATTGCTGACCGCAAAAGTCTATTATCATTTC

TGCCACCACCGAAGCAAACTGCTGACCAATTGTCAATTTTATTCATCCTCTCAGCTTACCGTTATGACAGATTAG

GCTACTATGACGATAAGTTTGCAGACCCAGAAGCTGAGGATATTGTAGCTACATTTCAGCAAGATTTGAACGA

GGTAGATCGAGAAATTGAGTTGAATAATAAGAGCCGTTTAATAAAGTATAACTATCTCAAACCAAGGCTTGTT

ACCAATAGTATTGGCATCTAA

Amino acid Sequence for WP_096538768.1

SEQ ID NO: 100

MKPYLPQNDPDPTKRKSFLERKQEEYEFDYDFLPPMAMLKDVPAVENFSTKYIAERAVETAELPINMLAVKTHTLW

DPLDELQDYEDYFPVLPKPTVIKTYQTDDSFCEQRLCGSNPMALRQIKEMPLDFEFTIQELQRKFGESINLAEKLANG

NLYITDYRSLSFVKGGTYERGRKYLPTPLAFFCWRSSGFSDRGQLVPIAIQLNPAAGKQSQLITPFDDPLAWFHAKLC

VQIADANHHEMSSHLCRTHFVMEPFAIVTARQLADNHPLNLLLKPHFRFMLANNDLGRKRLVNRGGPVDELLAG

TLQESLQIVVNAYKEWSLDKFALPTEIKNRGVDDPQKLPHYPYRDDGMLLWNAIKKFVSEYLNLYYKTPEDLTADFE

LQAWAQELVSQSGGRVKGVPDRIEKLEQLIDIATAVIFTCGPQHAAVNYPQYEYMTFMPNMPLAGYKQMTSEGT

IADRKSLLSFLPPPKQTADQLSILFILSAYRYDRLGYYDDKFADPEAEDIVATFQQDLNEVDREIELNNKSRLIKYNYLK

PRLVTNSIGI

-continued

Coding sequence for RCJ25669.1

SEQ ID NO: 101

ATGAATCCATACCTTCCTCAAAATGATCCTGACCCAACAAAACGCAAGTTTTCTTTAGAGCGTAAGCTAGAAGA
ATACGAATTCGATTACAACTTTTTACCGCCGATGGCGATGCTTAAAGATGTACCTGCCGTGGAAAATTTTTCTA
CCAAGTATATTGCTGAACGTGCAGTAGAAACGGCAGAACTTCCTCTCAACATGTTGGCTGTTAAAACCCGTAG
TTTATGGGACCCTTTGGATGAATTGCAAGACTATGAAGATTATTTTCCAGTCTTGCCTAAACCTGATGTCATCA
AAACATACCAAACTGATGACTCGTTTTGCGAGCAACGGTTGTGTGGGGCAAATCCTATGGCTTTACGCCAAAT
TAAAGAGATGCCTTTAGGCTTTGAGTTTACTATTCAAGAATTGCAAGAAAAGTTTGGGGAATCTATCAATTTG
GCAGAAAAACTTGCCAATGGAAATTTATATATAACTGATTATAGACCACTTTCATTTGTTAAAGGAGGCACTTA
CGAAAGAGGTAAAAAGTATTTACCAACACCGTTAGCTTTTTTCTGTTGGCGTAGTTCTGGTTTTAGCGATCGCG
GTCAACTTGTACCTATTGCCATTCAACTCAATCCCGCACTCGGCAAACAAAGTCAATTAATCACACCTTTTGACG
ATCCTTTGACTTGGTTTCATGCTAAACTATGCGTTCAAATCGCTGATGCTAACCATCATGAAATGAGTAGCCAT
CTTTGTCGAACTCACTTTGTTATGGAACCTTTCGCCATTGTTACAGCTCGGCAATTAGCTGATAATCACCCTCTT
AACATATTACTAAAACCCCACTTCCGTTTCATGTTGGCTAATAATGACTTGGGTCGCAAGCGCTTAGTTAATAG
GGGCGGTCCTGTTGATGAATTGCTAGCTGGAACTCTGCAAGAATCATTACAAATTGTTGTCAATGCCTATAAA
GAATGGAGTTTAGATCAATTTGCCTTACCCACGGAAATCAAAAATCGTGGTGTGGATAATCCAGACAACTTGC
CTCACTATCCCTATCGAGATGATGGGATGCTCTTGTGGAATGCCATTAAAAAGTTCGTGTCTGAATATTTGAAG
TTATACTACAAAACTCCCGAAGATTTGACAGCAGACTTTGAATTGCAAGCTTGGGCACAGGAACTAGTTTCTCA
ATCAGGCGGACGAGTTAAAGGCGTTCCTTCGCGCATTGAAAAATTAGAACAATTAGTTGACATTACTACTGCG
GTAATTTTCACTTGTGGGCCGCAACACGCTGCTGTTAACTATCCACAATATGAATATATGACCTTCATGCCGAA
TATGCCCCTTGCTGGTTATAAACAAATGACATCAGAAGGCACTATTCCTGACCGCAAAAGCCTATTATCATTTC
TGCCACCCCCTAAGCAAACTGCTGACCAATTGTCAATTTTATTCATCCTCTCAGCTTACCGTTATGACAGATTAG
GCTATTATGACGATAAATTTGCAGACTCAGAAGCTGAGCAAATTTTAGTTACATTCCACCAAGATTTGACCGAG
GTAGAGCGAGAAATTGAATTGAATAACAAGAGCCGTTTAATCAAGTATGACTATCTCAAACCAAGGCTTGTAA
CCAATAGCATCAGCATCTAA

Amino acid Sequence for RCJ25669.1

SEQ ID NO: 102

MNPYLPQNDPDPTKRKFSLERKLEEYEFDYNFLPPMAMLKDVPAVENFSTKYIAERAVETAELPLNMLAVKTRSLW
DPLDELQDYEDYFPVLPKPDVIKTYQTDDSFCEQRLCGANPMALRQIKEMPLGFEFTIQELQEKFGESINLAEKLAN
GNLYITDYRPLSFVKGGTYERGKKYLPTPLAFFCWRSSGFSDRGQLVPIAIQLNPALGKQSQLITPFDDPLTWFHAKL
CVQIADANHHEMSSHLCRTHFVMEPFAIVTARQLADNHPLNILLKPHFRFMLANNDLGRKRLVNRGGPVDELLAG
TLQESLQIVVNAYKEWSLDQFALPTEIKNRGVDNPDNLPHYPYRDDGMLLWNAIKKFVSEYLKLYYKTPEDLTADFE
LQAWAQELVSQSGGRVKGVPSRIEKLEQLVDITTAVIFTCGPQHAAVNYPQYEYMTFMPNMPLAGYKQMTSEGT
IPDRKSLLSFLPPPKQTADQLSILFILSAYRYDRLGYYDDKFADSEAEQILVTFHQDLTEVEREIELNNKSRLIKYDYLKP
RLVTNSISI

Coding sequence for WP_017318478.1

SEQ ID NO: 103

ATGAAACCCAACTTACCGCAACACGAGCCAAATCCCGAAGCTCGGAGAAATTGGCTAGAACAAAACCGAGAA
GATTATAAATTCGACCATAATTATCTGGCTCCCATACCAATACTTGATAAGGTGCCTCATCAAGAACTCTTCTCG
CCGAAATATACTGCTAAACGCTTAGCAAGTATGGCGAATCTCGTACCTAATATGCTTGCTGCCAAAGCCAGAA
ATTTCTTCGATCCGCTGGATGAATTAGAAGAATATGAAGACCTTTTGCCGATATTACCAAAGCCCTCTGTCATA
AAAAATTATAAAACAGACTCGTGTTTCGCCGAGCAAAGACTCTCTGGGGCAAACCCGATGGCAATGCACAGG
ATTGACGCGCTCCCGGAAAATTTCCCTGTCACAAACGACCACTTTCAAAAAGCCGTAGGTGCAGCTCACGATC

-continued

TGGAGGCGGCACTCAAAGAAGGCAAACTCTATTTATTAGATTATCCTTTGCTATTTGACATTAAAGGCGGTACC

TACCAAAACATTAAAAAGTATCTTCCCAAGCCGCAGGCTCTATTTTACTGGCAAAGCAATGGCAATAAAAATA

GTGGTTCTCTGATGCCTATTGCCATTCAGCTCCATAATGATACTGACGGAGATAGCCTAATTTACACACCAGAT

GACCCCCATTTAGATTGGTTTTTGGCAAAAACTTGCGTACAAATGGCTGATGGGAACCATCAGGAATTGGGCA

GTCATTTTGCACGAACTCATGCAGTTATGGGTCCGTTTGCAGTCGTCACGGCTCGACAACTCGGAGAAAACCA

TCCCCTCTCCTTACTCCTGAGACCCCACTTCCGGTTCATGCTCTATGATAACGATTTGGGGCGTACTCACTTTTT

ACAACCAGGAGGTCCAGTTGATGAATTTATGGCAGGTACGTTGCAGGAGTCTCTTGGTTTCGTTGGCAAAGCC

TACGAAGAATGGAGTTTAGACAATGCTGTCTTCGCGACGGAAATAAAAAATCGCAAAATGGATGATCCAGAA

ATTTTGCCGCACTATCCTTTCCGGGATGACGGGATGTTAGTCTGGGATGCGGTCAAAAAGTTTGTCACTGAAT

ACATCCAACTCTATTACAAAACTCCCCAAGACTTGAGTGAGGATTATGAATTGCAAAATTGGGCGAGAGAATT

GGCTGCCCAAGATGGTGGTCGTGTTAAGGGGATGCCAGAGAAAATTGAGACCATAGAGCAACTCATTGACAT

TGTGACTGTAGTCGTCTTCACCTGCGCTCCTCTCCACTCGGCTTTGAATTTTTCCCAGTACGAATACATGGCTTT

TGTACCCAATATGCCGTATGCAGCCTACCACCCTGTTCCAGAAACAAAGGGTGTGGATATGCAAACGATCATG

AAGATGCTTCCACCCTTTAAGCACGCTGCCGATCAGGTGATGTGGTCGGATATTTTGACATCCTTCCATTACGA

CAAATTGGGTCACTATGATGAAGAATTTGCCGACCCAATTGCTCAGGAAATTCTTGTGCAGTTTCAACAAAATT

TACATGAAGTGGAACGACAAATAGAAATTAAAAACCAATCTCGTCCAATACCTTATAACTACCTCAAGCCTTCT

GAAATTATTAATAGCATCAATACTTGA

Amino acid Sequence for WP_017318478.1

SEQ ID NO: 104

MKPNLPQHEPNPEARRNWLEQNREDYKFDHNYLAPIPILDKVPHQELFSPKYTAKRLASMANLVPNMLAAKARN

FFDPLDELEEYEDLLPILPKPSVIKNYKTDSCFAEQRLSGANPMAMHRIDALPENFPVTNDHFQKAVGAAHDLEAAL

KEGKLYLLDYPLLFDIKGGTYQNIKKYLPKPQALFYWQSNGNKNSGSLMPIAIQLHNDTDGDSLIYTPDDPHLDWFL

AKTCVQMADGNHQELGSHFARTHAVMGPFAVVTARQLGENHPLSLLLRPHFRFMLYDNDLGRTHFLQPGGPVD

EFMAGTLQESLGFVGKAYEEWSLDNAVFATEIKNRKMDDPEILPHYPFRDDGMLVWDAVKKFVTEYIQLYYKTPQ

DLSEDYELQNWARELAAQDGGRVKGMPEKIETIEQLIDIVTVVVFTCAPLHSALNFSQYEYMAFVPNMPYAAYHP

VPETKGVDMQTIMKMLPPFKHAADQVMWSDILTSFHYDKLGHYDEEFADPIAQEILVQFQQNLHEVERQIEIKNQ

SRPIPYNYLKPSEIINSINT

Coding sequence for KJH71567.1

SEQ ID NO: 105

ATGATAAAACCATATTTACCTCAACACGAGCCTGATGCGATCGCGCGGCAAAATCGCTTAATCAAAAAACCGCG

CTGATTATGTTCTCGACTATAACTATCTGCCACCTATTCCTTTGCAAACTCCTGTTCCTCAACAAGAACGTTTTTC

TGCTGAATACACTGCAAGGCGTTTAGCTAGTTTTGCTAATCTCGTCCCCAATATGTTGATGGCGAGGGCGAGA

AATGCTTTCGATCCTTTAGATACGTTAGAGGAATACGCGGACTTATTACCAGTCTTACCAAAACCTAATGTCAT

CAAAAATTATCAAGCAGATTGGTGTTTTGCCGAACAAAGATTATCTGGTATTAACCCGCCAGCTATCCGCCGCA

TAGATGCTTTGCCAGAAAATTTGCCCATCTCTAACTCTTCGTTTCAACACTCTGTAGGTGCAGAACATAATCTG

GAACAAGCACTCAAAGAAGGTAAGTTGTATTGTTTAGACTACCCGTTGTTATCTGGTATTGGAGGCGGTAATT

ACCAGAATTTACCTAAATATCTGCCCAAACCGCAAGCGCTCTTTTATTGGCGTAGTGATAATAGCAAAATCGGC

GGCTCTTTAGTTCCGGTAGCGATTAAAATTCTCAATGAATTGGGAGGGAAAAATTTAGTCTATACGCCCAATG

ATGCACCTCTCGACTGGTTTCTTGCCAAAACCTGCGTGCAAATGGCAGATGCAAACCATCAGGAATTAGGCAC

TCATTTTGCTAAAACTCATGCTGTTATGGCTCCTATTGCGGCAATTACAGCTAGGGAATTAGGCGAAAACCATC

CTTTAACTTTGCTGCTAAAACCTCATTTCCGGTTCATGCTGTTTGATAATGAGTTAGGACGCACGCAGTTTTTGC

AACCTACTGGTCCTACTGAAGAACTGCTAGCTGGAACGCTGGAAGAATCTGTGCAATTGGTCGTGCAAGCTTA

TGAGGAATGGAGTATAGATACTACTTTTCCTTTAGAATTGCAGCAACGGCAAATGCATGACCCAGAGATTTTA

-continued

CCTCATTACCCGTTCCGAGATGATGGCATATTAGTCTGGAATGCTATACATCAGTTTGTTACTGAATATTTGCA
GATTTACTACCACACTCCGCAAGATATCAGTGCAGACTACGAGGTGCAAAATTGGGCTAGGGAATTGGTAGA
TAGCGGTCGAGTTAAAGGAATGCCAGAGAGCATTGATACTCTAGCACAACTAATTGACATTATCGCTGTAGTC
ATCTTTACCTGCGCTCCTCTGCATTCTTGCTTGAATTTAGCCCAGTACGAATACATGACTTTCGTGCCAAATATG
CCTTATGCAGCCTACCACCCTATTCCCACTACTAAGGGCGTAGATATGGCAACTATTGTCAAAATTATGCCGCC
TTTTCAAAGAGCGATCGATCAAATATTGTGGACGGATATTTTGAGCGCTTTCCAATATGACAAGTTGGGTTTTT
ATGAGGAAGATTTTGCCGATCCCAAGGCTCAGGAAGTGCTACAGCGCTTTCAAGATAACTTGCAGCAGGTAG
AAGAAAAGATAGAAATGCACAATCAGATTCGCCCAATACCTTACAACTACCTCAAGCCTTCTCGGATTATGAAC
AGCATTAATACTTAA

Amino acid Sequence for KJH71567.1

SEQ ID NO: 106

MIKPYLPQHEPDAIARQNRLIKNRADYVLDYNYLPPIPLQTPVPQQERFSAEYTARRLASFANLVPNMLMARARNA
FDPLDTLEEYADLLPVLPKPNVIKNYQADWCFAEQRLSGINPPAIRRIDALPENLPISNSSFQHSVGAEHNLEQALKE
GKLYCLDYPLLSGIGGGNYQNLPKYLPKPQALFYWRSDNSKIGGSLVPVAIKILNELGGKNLVYTPNDAPLDWFLAK
TCVQMADANHQELGTHFAKTHAVMAPIAAITARELGENHPLTLLLKPHFRFMLFDNELGRTQFLQPTGPTEELLA
GTLEESVQLVVQAYEEWSIDTTFPLELQQRQMHDPEILPHYPFRDDGILVWNAIHQFVTEYLQIYYHTPQDISADYE
VQNWARELVDSGRVKGMPESIDTLAQLIDIIAVVIFTCAPLHSCLNLAQYEYMTFVPNMPYAAYHPIPTTKGVDMA
TIVKIMPPFQRAIDQILWTDILSAFQYDKLGFYEEDFADPKAQEVLQRFQDNLQQVEEKIEMHNQIRPIPYNYLKPSR
IMNSINT

Coding sequence for WP_017327314.1

SEQ ID NO: 107

ATGAATACTGCTGTCAGACCTTCATTGCCACAAAAGGATCCTAACTCCAACAAGCGCAATGATTATTTAGAGC
GCAACCGAGAGGATTATCAATTCGATCGCAGCCTATTACCCCCTCTCCCCTTCATGCAGAAGGTTCCAAAACGG
GAATATTTTTCACCCGAATATACCGCGAAACGGCTCGCCAGTATGGCTAACCTGCCTGCTAATATGCTAGCTGC
TAAAGCTAAGCGCTTTCTCGATCCCCTCGATAGCCTGGAAGAATACGAGGAGCTGATTCCTCTGCTATCTAAAC
CCAATCTGCTGAAGAACTATCGCACTGACGAATTTTTTGGGGAGCAGCGACTGTCGGGAGCCAACGCCATGG
CAACGCGCCGACTGGCAAAACTTCCCAGTGATTTTGCTGTGGATAATGCTCTGTTTCAGCAGGTGTTGGAGAC
CGATGGAACTCTCGACGCAGCCTTAGCTGAAGGTAGACTTTATTTTCTGGAACATCCCTATCTCAATCGCATCA
AAGGAGGGGAATCGGAGTACGGTCGCAAATACATGCCCAAAACGCGATCGCTGTTCTATTGGAAAAGTGACG
ACTCTCCAGTGGGGGGTGCTCTTTTGCCAGTGGCGATCGAACTCAAAAGCGAAGCCACGAATACCCCGATTGT
CTATACTCCCAAAGATGCCCCCCTCGATTGGCTGTTTGCCAAACTCTGCGTCCAAGTCGCCGACGCCAACCATC
AAGAATTAGGCTCCCACTTTGCCTTCACCCACACCGCCATGGGGCCGTTTGCCATGGTTACTGCTCGGCAATTG
GCTGAAAACCATCCCGTGTCGCTGTTATTAGAACCTCACTTCCAGTTCATGCTGTTTGATAACGATTTGGGGCG
GGCACAGTTTCTCAACCCCGGCGGTCCAGTCGATCGCTTTTTGGCTGGAACTCTCGAAGAAACCCTTACTTTTG
TGGTCGACACCCTCGATCGTTGGAGTATTGATACCTTTGACTTCCCATCGATTATCGAGCGCCAAAACATGGAT
GACCCAGAGGTGCTGCCCCACTATCCCTTTAGAGATGACGGCATGTTGATTTGGGATGCTGTGAAGGAATTTA
TTACCAATTACCTCAGCATCTATTACAAAACCCCTGAGGATATTAGGGAGGACTACGAACTACAAAATTGGGC
GAAAGAATTAGCAGCATTTGATAGCGGTCGAGTCAAGGGAATGCCCGAAACTATTGAGTCATTGCAGCAGCT
GATCGATATCCTGTCTGTCGTGATTTTCACCTGTGCTCCCCTGCATTCTAACTTGAACTTCACTCAATACGAATA
CATGATCTTCGTTCCCAATATGCCTTACGCCGCATATCATCCGGTACCAGAGCAGAAGGGGATCGATATGGAA
ACCATTCTGAAGTTTCTACCCCCCTACAAACAAGCGGCCGATCAAGTGTATTGGACGATGGTCTTGACCTCTTA
CCATCACGACAAGCTAGGCTTTTACGAAGATGATTTTGCCGATCCTCTAGCCCAAGATGCCCTCGTTCAATTCC

-continued

AGCAAAACCTAGCGGATATCGAACGCAAGATCGAGATTGAAAATCAACATCGTCCGGTCCCCTATCAGTATTT

CTTGCCATCTGAAATTATTAACAGCATTAATACTTGA

Amino acid Sequence for WP_017327314.1

SEQ ID NO: 108

MNTAVRPSLPQKDPNSNKRNDYLERNREDYQFDRSLLPPLPFMQKVPKREYFSPEYTAKRLASMANLPANMLAA

KAKRFLDPLDSLEEYEELIPLLSKPNLLKNYRTDEFFGEQRLSGANAMATRRLAKLPSDFAVDNALFQQVLETDGTLD

AALAEGRLYFLEHPYLNRIKGGESEYGRKYMPKTRSLFYWKSDDSPVGGALLPVAIELKSEATNTPIVYTPKDAPLDW

LFAKLCVQVADANHQELGSHFAFTHTAMGPFAMVTARQLAENHPVSLLLEPHFQFMLFDNDLGRAQFLNPGGP

VDRFLAGTLEETLTFVVDTLDRWSIDTFDFPSIIERQNMDDPEVLPHYPFRDDGMLIWDAVKEFITNYLSIYYKTPEDI

REDYELQNWAKELAAFDSGRVKGMPETIESLQQLIDILSVVIFTCAPLHSNLNFTQYEYMIFVPNMPYAAYHPVPEQ

KGIDMETILKFLPPYKQAADQVYWTMVLTSYHHDKLGFYEDDFADPLAQDALVQFQQNLADIERKIEIENQHRPVP

YQYFLPSEIINSINT

Coding sequence for WP_100898502.1

SEQ ID NO: 109

ATGAAACCTTACTTACCGCAGAACGATCCAAATGGTAATTATCGAGCAAGTTGGCTGGATAAAAATAGAGAA

GAGTACAATTTTAATTATGATTATCTGGCTCCTTTACCAGTAATTGATAAAGTGCCTCACAAGGAAATATTCTCA

GCAGAATATACTGCTAAACGCTTGGCAAGTATGGCAACTCTTGCACCAAATATGTTGGCTGCTAAAGCCAGAA

ATTTCTTAGACCCGCTAGATGAGTTGGAAGAATATGAAGAACTTTTGGCACTACTACCAAAACCCGATGTCAT

AAAAAATTATAAAACAGACTCGTGTTTTGCTGAACAACGACTTTCGGGGGCAAACCCATTAGCTATCCGAAGA

ATTAATGTATTACCTGATAATTTTGCTGTAACTGATTACCATTTTCAGAAGATTGCAGGTGCAGAATTTACTTTG

GAAAAGGCACTCAAGGAAGGCAAGCTGTATTTCTTAGATTACCCTTTGCTATCTGATATTCAAGGTGGTGTCTA

TAATAATGTTAAAAAGTACCTTCCCAAGCCGCAAGCTCTATTTTACTGGCAAAGTAATGATAGTTTTAATGGTG

GTTCTCTAGTGCCTGTTGCTATCCAGATTAATCATGACTCTGGCGCAAATAGCCTGTATACACCAGATGACCCC

CATTTAGATTGGTTTTTGGCAAAAACCTGCGTCCAAATTGCTGATGGCAACCACCAAGAATTGGGTAGTCATTT

TTCCTATACCCATGCAGTTATGGCTCCGTTTGCAATTGTAACTGCGCGGCAATTAGCAGAAAATCATCCCATCG

CCTTACTGTTAAAACCTCACTTCCGTTTCATGCTATTTGATAACGATTTGGGACGCACTCAGTTTTTACAGCCTG

GTGGACCGGTTGATGAGTTTATGGCAGGTTCATTAGCAGAATCTGTTGGATTTGTGGCGAAAACTTATGAAGA

ATGGAGTGTAGAAAAGTTTACCTTCCCTCGGTTAATAAAAAGCCGTCAAACAGATGACCCAGAAATTTTGCCG

CACTTTCCTTTCCGGGACGATGGAATATTAATCTGGAATGCCATCGAAAAGTTTGTGGCTGAATACTTGCAACT

CTATTATAAGACTTCACAGGATCTCAGCGATGACTATGAATTGCAAAATTGGGCTAGGGAATTAGTCGCCCAA

GATGGTGGTAGAGTCAAGGGAATGCCAGCCAAGATTGAGACTTTAGAACAACTGATTGAAATCATTAGTGTA

GTAGTCTTCACTTGCGCTCCTCTCCACTCTGCTTTGAATTTTTCTCAGTACGAATATATGGCTTTTGTGCCCAATA

TGCCTTATGCAGCCTACCACCCAATTCCAGAAACTAAGGGTGTGGATTTGGAAACTATTATGAAAATACTTCCT

CCCTTTAAACAAGCTGCCGATCAGGTAATGTGGACTGAGATTTTGACATCGTTCCATTATGACAAATTAGGTTT

TTATGATGAGGAGTTTGCTGATCCATTGGCGCAGGAAATTGTGGTGCAATTCCAACATAATCTCCATCAAATA

GAACGGCAAATAGACATCAGAAATCAAACTCGTCCCATACCTTACAATTACCTTAAACCTTCGCAAATTATTAA

TAGCATCAATACTTAA

Amino acid Sequence for WP_100898502.1

SEQ ID NO: 110

MKPYLPQNDPNGNYRASWLDKNREEYNFNYDYLAPLPVIDKVPHKEIFSAEYTAKRLASMATLAPNMLAAKARNF

LDPLDELEEYEELLALLPKPDVIKNYKTDSCFAEQRLSGANPLAIRRINVLPDNFAVTDYHFQKIAGAEFTLEKALKEGK

LYFLDYPLLSDIQGGVYNNVKKYLPKPQALFYWQSNDSFNGGSLVPVAIQINHDSGANSLYTPDDPHLDWFLAKTC

VQIADGNHQELGSHFSYTHAVMAPFAIVTARQLAENHPIALLLKPHFRFMLFDNDLGRTQFLQPGGPVDEFMAGS

LAESVGFVAKTYEEWSVEKFTFPRLIKSRQTDDPEILPHFPFRDDGILIWNAIEKFVAEYLQLYYKTSQDLSDDYELQN

-continued

WARELVAQDGGRVKGMPAKIETLEQLIEIISVVVFTCAPLHSALNFSQYEYMAFVPNMPYAAYHPIPETKGVDLETI

MKILPPFKQAADQVMWTEILTSFHYDKLGFYDEEFADPLAQEIVVQFQHNLHQIERQIDIRNQTRPIPYNYLKPSQII

NSINT

Coding sequence for RCJ35150.1

SEQ ID NO: 111

ATGGTGAAACCATATTTACCACAAAAAGATCCTGATGTTAATGTCCGAATCAATTGGCTAGATAAAAATCGAG

AAGAGTACAAATTTAATTACGATTATCTAGCTCCTCTACCAGTAATTGATAAAGTTCCTCATAAGGAAATATTCT

CGGCGGAATATACTGCTAAACGTTTGGCAAGTATGGCAACTCTTGCACCAAATATGCTAGCTGCCAAAGCCAG

AAATTTCTTAGACCCATTGAATGAATTGGAAGAATATGAAGAACTTTTGTCACTCCTACCAAAACCTGATGTTA

TAAAAAATTACAAAACAGACTCTTGTTTTGCAGAACAACGCCTCTCTGGAGCAAACCCATTAGCTATCCAAAAA

ATTGATGTATTACCTGATAATTTTGCTGTCACAGATGCACATTTTCAGAAAGTAGCAGGTACAGAATTTACTTT

AGAAAAGGCACTTAAGGAAGGCAAGCTGTATTTCTTAGATTATCCTTTGTTATCTGATATTCAAGGTGGTATCT

ACGAGAATGTTAAAAAGTACCTTCCCAAGCCACAAGCTCTATTTTATTGGCAAAGTAATGATAGTTCTAATGGT

GGTTCTCTAGTACCTGTTGCCATTCAGATTAATCATGACTCTGGTGCAAAAAGCGTGATTTATACACCAGATGA

TCCCCATTTAGATTGGTTTTTGGCAAAAACCTGCGTTCAAATTGCTGATGGCAACCATCAAGAGTTGGGTAGTC

ATTTCGCCTATACCCATGCAGTTATGGCTCCGTTTGCAATTGTAACTGCGCGGCAACTAGCAGAAAATCATCCC

ATCGCTTTACTGTTAAAACCCCATTTCCGTTTCATGCTATTTGATAACGATTTGGGGCGCACTCAGTTTTTACAA

CCTGGAGGCCCGGTTGATGAGTTTATGGCAGGTTCATTGGCGGAGTCTCTTGGATTTGTGGCGAAAGTTTATG

AAGAATGGAGTGTTGAAAAATTTACCTTTCCTCGGTTAATAAAAAGTCGTCGAACGGATGACCCAGAAATTTT

ACCGCACTTTCCTTTTCGGGATGATGGCATATTAATCTGGAATGCCGTCGAAAAGTTTGTGTATGAATATTTGC

AACTCTATTACAAAACCTCACAGGATCTAATTGATGACTATGAGTTGCAAAATTGGGCTAGAGAATTAGTTGC

CCAAGATGGTGGTAAAGTCAAGGGAATGCCAGCGAAGATTGAGACTCTAGAACAACTAATCGAAATCATCAG

TGTGGTAGTATTCACTTGCGCTCCTCTACACTCTGCTTTGAATTTTTCTCAGTACGAATATATGGCTTTTGTACCC

AATATGCCCTATGCAGCCTACCACCCAATTCCAGAAACTAAAGGTGTGGACTTGGAAACTATCATGAAGATAC

TTCCTCCCTTTAAACAAGCTGCCGATCAGGTGATGTGGACTGAGATTTTAACATCGTACCACTATGATAAATTG

GGTTTTTATGATGAGGAGTTTGCTGATCCGTTGGCGCAGGAAATTGTGGTGCAATTCCAACAGAATTTGCATG

AAATAGAACGGCAAATAGATATTAAAAATCAAACTCGTCCCATACCTTACAACTACTTCAAGCCTTCGCAAATT

ATTAACAGCATTAATACTTGA

Amino acid Sequence for RCJ35150.1

SEQ ID NO: 112

MVKPYLPQKDPDVNVRINWLDKNREEYKFNYDYLAPLPVIDKVPHKEIFSAEYTAKRLASMATLAPNMLAAKARN

FLDPLNELEEYEELLSLLPKPDVIKNYKTDSCFAEQRLSGANPLAIQKIDVLPDNFAVTDAHFQKVAGTEFTLEKALKE

GKLYFLDYPLLSDIQGGIYENVKKYLPKPQALFYWQSNDSSNGGSLVPVAIQINHDSGAKSVIYTPDDPHLDWFLAK

TCVQIADGNHQELGSHFAYTHAVMAPFAIVTARQLAENHPIALLLKPHFRFMLFDNDLGRTQFLQPGGPVDEFM

AGSLAESLGFVAKVYEEWSVEKFTFPRLIKSRRTDDPEILPHFPFRDDGILIWNAVEKFVYEYLQLYYKTSQDLIDDYEL

QNWARELVAQDGGKVKGMPAKIETLEQLIEIISVVVFTCAPLHSALNFSQYEYMAFVPNMPYAAYHPIPETKGVDL

ETIMKILPPFKQAADQVMWTEILTSYHYDKLGFYDEEFADPLAQEIVVQFQQNLHEIERQIDIKNQTRPIPYNYFKPS

QIINSINT

Coding sequence for WP_094352972.1

SEQ ID NO: 113

ATGAAACCATATTTACCACAAAAAGATCCTGATGTTAATGTCCGAATCAATTGGCTAGATAGAAATCGAGAAG

AGTACAAATTTAATTACGATTATCTAGCTCCTCTACCAGTCATTGATAAAGTTCCTCATAAGGAAATCTTCTCGG

CAGAATATACTGCTAAACGTTTGGCAAGTATGGCAAGTCTTGCACCAAATATGCTAGCTGCTAAAGCCAGAAA

-continued

CTTCTTAGACCCATTAGATGAATTGGAAGAATACGAAGAACTTTTGTCACTCCTACCAAAACCCGATGTCATAA
AAAATTACAAAACAGACTCTTGTTTTGCGGAACAACGACTCTCTGGAGCGAACCCATTAGCTATCCAAAAAATT
GATGTATTACCTGATAATTTTGCTGTCACAGATGCACATTTTCAGAAGGTTGCAGGTACAGAATTTACTTTGCA
AAAAGCACTCAAGGAAGGCAAGCTGTATTTCTTAGATTATCCTTTATTATCTGATATTAAAGGTGGTGTCTACG
ATAATGTTAAAAAGTACCTTCCCAAGCCACAAGCTCTATTTTACTGGCAAAGTAATGATAGTTCTAATGGTGGT
TCTCTAGTGCCTGTTGCCATCCAGATTAATCATGACTCTGGTGGAAAAAGCGTGATTTATACACCAGATGACCC
CCATTTAGATTGGTTTTTGGCAAAAACCTGCGTTCAAATTGCTGATGGCAACCATCAAGAATTGGGTAGTCATT
TCGCCTATACCCATGCAGTTATGGCTCCGTTCGCGATTGTAACTGCGCGGCAACTAGCAGAAAATCATCCCATC
GCTTTACTGTTAAAACCCCACTTCCGTTTTATGCTATTTGATAACGATTTGGGGCGCACTCAGTTTTTACAACCT
GGAGGCCCGGTTGATCAGTTTATGGCAGGTTCATTGGCGGAGTCTCTTGGATTTGTAGCGAAGGTTTATGAA
GAATGGAGTGTTGAAAAATTTACCTTCCCTCGGTTAATAAAAAGTCGCCGAACCGATAACCCAGAAATTTTAC
CGCACTTTCCTTTCCGGGACGATGGCATATTAATTTGGAATGCCGTCGAAAAGTTTGTGGCTGAATACTTGCAA
CTCTATTACAAAACCTCACAAGATATCAGTGACGACTATGAGTTGCAAAATTGGGCTAGAGAATTAGTAGCTC
AAGATGGTGGTAAAGTCAAGGGAATGCCAGCCAAGATTGAGACTCTAGAACAACTGATTGAAATCATCAGTG
TGGTAGTATTCACTTGCGCTCCTCTACATTCTGCTTTGAATTTTTCTCAGTACGAATATATGGCTTTTGTACCCAA
TATGCCCTATGCAGCCTACCACCCAATTCCAGAAACTAAAGGTGTGGACTTGGAAACTATCATGAAGATACTTC
CTCCTTTTAAACAAGCTGCCGATCAGGTGATGTGGACTGAGATTTTAACATCGTACCACTATGACAAATTGGGT
TTTTATGATGAGGAGTTTGCCGATTCATTGGCGCAGGAAATTGTGGTGCAATTCCAACAAAATTTGCATGAAA
TAGAACGGCAAATAGACATTAGAAATCAAACTCGTCCCATACCTTACAACTACTTCAAGCCTTCGGAAATTATT
AACAGCATTAATACTTGA

Amino acid Sequence for WP_094352972.1

SEQ ID NO: 114

MKPYLPQKDPDVNVRINWLDRNREEYKFNYDYLAPLPVIDKVPHKEIFSAEYTAKRLASMASLAPNMLAAKARNFL
DPLDELEEYEELLSLLPKPDVIKNYKTDSCFAEQRLSGANPLAIQKIDVLPDNFAVTDAHFQKVAGTEFTLQKALKEGK
LYFLDYPLLSDIKGGVYDNVKKYLPKPQALFYWQSNDSSNGGSLVPVAIQINHDSGGKSVIYTPDDPHLDWFLAKTC
VQIADGNHQELGSHFAYTHAVMAPFAIVTARQLAENHPIALLLKPHFRFMLFDNDLGRTQFLQPGGPVDQFMAG
SLAESLGFVAKVYEEWSVEKFTFPRLIKSRRTDNPEILPHFPFRDDGILIWNAVEKFVAEYLQLYYKTSQDISDDYELQ
NWARELVAQDGGKVKGMPAKIETLEQLIEIISVVVFTCAPLHSALNFSQYEYMAFVPNMPYAAYHPIPETKGVDLE
TIMKILPPFKQAADQVMWTEILTSYHYDKLGFYDEEFADSLAQEIVVQFQQNLHEIERQIDIRNQTRPIPYNYFKPSEI
INSINT

Coding sequence for WP_104909167.1

SEQ ID NO: 115

ATGAAACCATACTTACCACAAAAAGATCCTGATGTTAATGTCCGAATCAATTGGCTAGATAAAAATCGAGAAG
AGTACAAATTTAATTACAATTATCTAGCTCCTCTACCAATTATTGATAAAGTTCCTCATAAGGAAATATTCTCGG
CGGAATATACTGCTAAACGTTTGGCAAGTATGGCAACTCTTGCACCAAATATGCTAGCTGCTAAAGCCAGAAA
CTTCTTAGACCCATTAGATGAATTGGAAGAATATGAAGAACTTTTATCACTACTACCAAAACCCGATGTTATAA
AGAATTACAAAACAGACTCTTGTTTTGCGGAACAAAGACTCTCTGGAGCGAACCCACTAGCTATCCAAAGAAT
TGATGTATTACCTGATAATTTTGCTGTCACAGATTCCCATTTTCAGAAGGTTGCAGGTACAAAATTGACGTTGG
AAAAGGCACTCAAGGAAGGCAAGCTGTATTTCTTAGATTACCCTCTGTTATCTGATATTCAAGGTGGTGTCTAC
GATAATATTCAAAAGTACCTTCCCAAGCCACAAGCTCTATTTTATTGGCAAAGTAATGATAGTTCTAATGGTGG
TTCTCTAGTGCCTGTTGCCATCCAGATTAATCATGACTCTGGTGCAAAAAGCGTGATTTATACACCAGATGACC
CCCATTTAGATTGGTTTTTGGCAAAAACCTGCGTTCAAATTGCTGATGGCAACCATCAAGAATTGGGTAGTCAT
TTTGCCTATACCCATGCAGTTATGGCTCCGTTTGCAATTGTAACTGCGCGGCAACTAGCAGAAAATCATCCCAT

-continued

CGCCTTACTGTTAAAACCTCACTTCCGTTTTATGCTATTTGATAACGATTTGGGACGCACTCAGTTTTTACAGCC
GGGAGGCCCGGTTGATGAGTTTATGGCAGGCTCATTGGCAGAGTCTCTTGGCTTTGTGGCGAAGGTTTATGA
AGAATGGAGTGTTGAAAAGTTTACCTTCCCTCGGTTAATAAAAAGTCGCCGAACGGATGACCCAGAAATTTTA
CCGCACTTTCCTTTCCGGGACGATGGCATATTAATTTGGAATGCTGTCGAAAAGTTTGTGGCTGAATACTTGCA
ACTCTATTACAAAACCTCACAAGAGTTAATTGATGACTATGAGTTGCAAAATTGGGCTAGAGAATTAGTGGCC
CAAGATGGTGGTAAAGTCAAGGGAATGCCAGACAAGATTGAGACCTTAGAACAACTGATTGAAATCATCAGT
GTGGTAGTATTCACTTGCGCTCCTCTACACTCTGCTTTGAATTTTTCTCAGTACGAATATATGGCTTTTGTACCC
AATATGCCCTATGCAGCCTACCACCCAATTCCAGAAATTAAAGGTGTGGACTTGGAAACTATTATGAAGATAC
TTCCTCCCTTTAAACAAGCTGCTGACCAAGTAATGTGGACTGAGATTTTAACATCGTACCACTATGACAAATTG
GGTTTTTATGATGAGGAGTTTGCCGATCCATTGGCGCAGGAAATTGTGGTGCAATTCCAACAGAATTTACATG
AAATAGAACGGCAAATAGACATTAGAAATCAAACTCGTCCCATACCTTACAACTACTTCAAGCCTTCGCAAATT
ATTAACAGTATCAATACTTGA

Amino acid Sequence for WP_104909167.1

SEQ ID NO: 116

MKPYLPQKDPDVNVRINWLDKNREEYKFNYNYLAPLPIIDKVPHKEIFSAEYTAKRLASMATLAPNMLAAKARNFL
DPLDELEEYEELLSLLPKPDVIKNYKTDSCFAEQRLSGANPLAIQRIDVLPDNFAVTDSHFQKVAGTKLTLEKALKEGK
LYFLDYPLLSDIQGGVYDNIQKYLPKPQALFYWQSNDSSNGGSLVPVAIQINHDSGAKSVIYTPDDPHLDWFLAKTC
VQIADGNHQELGSHFAYTHAVMAPFAIVTARQLAENHPIALLLKPHFRFMLFDNDLGRTQFLQPGGPVDEFMAG
SLAESLGFVAKVYEEWSVEKFTFPRLIKSRRTDDPEILPHFPFRDDGILIWNAVEKFVAEYLQLYYKTSQELIDDYELQ
NWARELVAQDGGKVKGMPDKIETLEQLIEIISVVVFTCAPLHSALNFSQYEYMAFVPNMPYAAYHPIPEIKGVDLET
IMKILPPFKQAADQVMWTEILTSYHYDKLGFYDEEFADPLAQEIVVQFQQNLHEIERQIDIRNQTRPIPYNYFKPSQI
INSINT

Coding sequence for WP_106217928.1

SEQ ID NO: 117

ATGAACGTAATTCAGCCGTCATCAGCGCAAATAGAGCGAGAAACGCGCCAGTTTTTACCAGATCGCGACCAGT
ATAAGTTTGACTACGATTTTCTCAAACCGCTAGCTCTGCTTCAACCCGTTGTTCCAGCCTTGCCGACTCCACCAG
GCTACCCTCGCGTGCCTGGGTCTTCTACCTTTTCACCTTACTATGTATTCACGCGGTCGTCACTGCCTAACACCC
TCGACCCCTTTGATGGACTGCAAGCCTTTGATGATTTTTTCCCCGCGCAGGGGAAGCCAGAAGTCAGTAAGAT
TTATCAAAGCGATCGCTCTTTTGCCGAGCAGAGATTATCTGGTGTGAATCCGATGGTACTTCATCGGATTGTGC
AGATTCCGCCTCAATCTTCTGTGACTTATGAAGAACTCCAGCTCGCTTGCCCCCATCTGCGGCTAGATATGGCA
TTAGCCAATGGCAATATTTATGTTGCCGATTACAGTGGACTCGGCTTTGTACAAGGTGGAACTTTTAAAGACCT
GAAAAAGTATTTACCCACCCCAGTTGCATTTTTCTACTTTGATGAAACTCAACAAGAATTAATCCCGATTGCAAT
TCAAGTACAGCCCAAACCAGGTGGAGCGATTTTCACTCCGCAAGATACACCGCTAGATTGGCTGGTAGCCAAG
ATGTGCGTTCAAATAGCAGATGCTAACCACCACGAGATGGGTGCTCATTTGTGCTGGACGCATTTTGTGATGG
AACCTTTTGCCATTTCTACACCTCGGCAACTAGCCATCAATCATCCAGTGCATTTACTGCTAGCGCCTCATCTGC
GCTTCCTGTTGGCAATTAACGATCAAGGCAGACAACTGCTAGTCAATCCCTACGTCGATGGTCAAGTGGGTGG
TCACGTCGATCGAATTATGGCAGGCACGTTAGAGGAATCCTTGGAAATTGTGAAGCACACCTATTCTGAATGG
AGTTTAGACAAGTTTGCTTTCCCGCAAGAAATACAGAATCGCGGATTGGAGGATGCGAACAAACTGCCGCACT
TCCCTTATCGAGATGATGGTCTGTTGCTCTGGAATGCCATTCATAAGTTTGTTTCCGGTTATCTCAAATATTGCT
ATCCCACACCCGCTGATATTCAAGCAGATCGTGAATTACAAGCTTGGGCGCAGGAACTAGCCTCGCCAGATGG
TGGACGGGTCAAAGGAATGCCTTGTTCGTTCTCGACGGTAGAGCAACTGATTGAGGTGATTGCCAACGTGATT
TTTACCTGTGGACCGCAGCACGCAGCCGTGAACTATTCACAATTCGACTACATGGCATACATTCCGAATATGCC

-continued

CCATGCTGCCTATGTCAATATCACTGGTAAAGGCATGATTCCAGATGAGAAAGCCCTGATGAAGTTCTTACCA

CCAAGGGATCAGGCAGAAGCTCAAATCAAAATTGTCACTTACCTGTCTTTCTATCGGCACGATCGCCTCGGCTA

TTACGATCGAGCGTTTAACCTTACCTTCCGCGAAACTCCAGTCAAGATGATGGTTCAGCAGTTCCAACAGGAG

TTGAATGAGATCGAGCAGCGGATTGATACCAGGAATCGGCAAAGGTTTGTACCTTATCCTTATCTCAAGCCTT

CCTTAGTTCCAAATAGCTTTAGTGCTTGA

Amino acid Sequence for WP_106217928.1

SEQ ID NO: 118

MNVIQPSSAQIERETRQFLPDRDQYKFDYDFLKPLALLQPVVPALPTPPGYPRVPGSSTFSPYYVFTRSSLPNTLDPF

DGLQAFDDFFPAQGKPEVSKIYQSDRSFAEQRLSGVNPMVLHRIVQIPPQSSVTYEELQLACPHLRLDMALANGNI

YVADYSGLGFVQGGTFKDLKKYLPTPVAFFYFDETQQELIPIAIQVQPKPGGAIFTPQDTPLDWLVAKMCVQIADA

NHHEMGAHLCWTHFVMEPFAISTPRQLAINHPVHLLLAPHLRFLLAINDQGRQLLVNPYVDGQVGGHVDRIMAG

TLEESLEIVKHTYSEWSLDKFAFPQEIQNRGLEDANKLPHFPYRDDGLLLWNAIHKFVSGYLKYCYPTPADIQADREL

QAWAQELASPDGGRVKGMPCSFSTVEQLIEVIANVIFTCGPQHAAVNYSQFDYMAYIPNMPHAAYVNITGKGMI

PDEKALMKFLPPRDQAEAQIKIVTYLSFYRHDRLGYYDRAFNLTFRETPVKMMVQQFQQELNEIEQRIDTRNRQRF

VPYPYLKPSLVPNSFSA

Coding sequence for WP_019498926.1

SEQ ID NO: 119

ATGAACGCGTATAACTTAGATCTGGATCCGACCTATATCAAATACAAAACTATTCTCACTGAAAACCGCAACGA

ATATGAATTCGATCTTAGCGATCGCGACCTCGCACCCATACCGATGCTGAAGGGAAACCTGCCGCGCTCGGAA

AACTTTTCCATCGATTACCTGGGTAGGGTAGCGGCTCCAATGGCTAAGCTGGCAGCAAATACCCTGGCGGTCA

AACTAAAATCTGCTTGGGATCCGCTTGACGAACTGCAAGACTATGAAGATTTCTTTCAGGTTCTGGAGAAACC

CAAAGTCATCTCTACCTACCAAAGCGATAAAGCCTTTGCCGAACAAAGACTGTCCGGCCCTAATCCCCTGGTAC

TCAAGCGAGTTGATGACTTAGCTCAATATTTTCAGAGCAGCGATATTGCCGAAATAGAAACCAAACTAGGCGA

CTCCATAGATTTGACAGATAACCTGTACGTTGCCGACTACACCGAACTGCTGCCCATTCCCAGCGGCACCTTCG

ATCGCGGGCGTACCTATTTACCCAGACCGATCGCTTTGTTTAGCTGGCGCAGTGAGGCATCTAGCGATCGCGG

TCAGCTCGTGCCCGTAGCAATTAAACTCGACGTGCCGCTCAAAGATAAAACCATCCTTACGCCCGAGGATGAA

TCGCTGGACTGGCTCTATGCCAAAACCTGCGTGCAGATTGCCGATGGCAACTATCACGAACTAATGAGCCACC

TCTGCCGCACGCATTTTGTGATGGAACCCTTTGCGATCGCCACCGGACAGCATTTGCCCGAAACCCATCATCTC

GGAGCGCTCTTGAGGCAGCATTTTAAATTTATGCTGGCGTTAAGTAAGTTTGCCCGCAAAACCCTGATTGCCA

GCGGTGGTTCGATCGATCGCATCTTGGCAGGAGAACTATCCGGTTCCCTAGAGATCATCAGGCAAGCCTTTAG

AACCTGGCGGTTCGATAGTTTTTCTTTCCCGCAAGCGATCGCGGCACGCGGTATGGACGATGCCCAAAAGCTG

CCTCACTACCCCTATCGCGATGATGGCAAGCTGGTTTGGGATGCAATTTGGCAATTTGTTTCAGCTTATTTGGG

GCTTCACTACCACACTGCCGATAGTATTAGCAGCGATCGGGCGTTGCAAGACTGGGCGCAAAAACTCCATCTC

GTGTTTAGCATAGCTGGCGGTGATGGCAAAGGGATGCCTGCACAAATAGATACGCTGGAGCAATTAGTGGAA

GTTGTGACTACGATTGTCTTCACCTGCGGGCCGCAACACGCGGCGGTCAATTTCCCTCAATACGAGTACATGA

CCTTTGCACCTAATATGCCGCTATCCTCTTATCGCGAGTTTGCCGGAGCAGCGGAGTTTACTCAAAAGGATTTC

ATGCGATTCCTACCGCCATCCCAACAAGCCGCCGGACAGCTCTCGACTACTTTTCTACTGTCTTCATTCCGCTAC

GATCGGTTGGGGCATTACGATCCATCTTTCTTCGAGGCCTTTGCCGATGGTATGCAGGACAAAGTCAAAACTG

TAGTAACGGCTTTTCAGCAGCAATTGGATGTGGTAGAGGCTGAAATCGATCGCCGCAACCAAAACCGGACAG

TTCCCTATCCCTATCTCAAACCATCGCTTATTCCTAACAGCATTAGCATCTAA

Amino acid Sequence for WP_019498926.1

SEQ ID NO: 120

MNAYNLDLDPTYIKYKTILTENRNEYEFDLSDRDLAPIPMLKGNLPRSENFSIDYLGRVAAPMAKLAANTLAVKLKSA

WDPLDELQDYEDFFQVLEKPKVISTYQSDKAFAEQRLSGPNPLVLKRVDDLAQYFQSSDIAEIETKLGDSIDLTDNLY

-continued

VADYTELLPIPSGTFDRGRTYLPRPIALFSWRSEASSDRGQLVPVAIKLDVPLKDKTILTPEDESLDWLYAKTCVQIAD
GNYHELMSHLCRTHFVMEPFAIATGQHLPETHHLGALLRQHFKFMLALSKFARKTLIASGGSIDRILAGELSGSLEIIR
QAFRTWRFDSFSFPQAIAARGMDDAQKLPHYPYRDDGKLVWDAIWQFVSAYLGLHYHTADSISSDRALQDWAQ
KLHLVFSIAGGDGKGMPAQIDTLEQLVEVVTTIVFTCGPQHAAVNFPQYEYMTFAPNMPLSSYREFAGAAEFTQK
DFMRFLPPSQQAAGQLSTTFLLSSFRYDRLGHYDPSFFEAFADGMQDKVKTVVTAFQQQLDVVEAEIDRRNQNRT
VPYPYLKPSLIPNSISI

Coding sequence for WP_103124384.1

SEQ ID NO: 121

ATGAAACCATATTTACCCCAGGTAGATCCTAATCCTAACATCCGCAAAGATGAGCTAGTAAAAAATCAAGCAG
ATTATAAATTTAATCACAATTATCTAGCTCCTATTCCCGTTATAGATAAAGTCCCTCACCAAGAATTATTCTCCG
CAGAATATACGGCTAAACGCCTCGCTAGTATGGCAAATTTAGCACCAAATATGCTGGCTGCCAAAGCAAGAAA
TTTCCTTGACCCTTTAGATGAATTAGAAGAATACGAAGAACTATTAACGCTGCTACCTAAACCAGCAGTGATGA
ACAATTATAAAACAGACTCATGTTTTGCCGAGCAAAGATTATCAGGTGCGAACCCTTTAGCTATTCAAAGAATT
GAGAATTTACCAGAAAATATTGGAGTAACTAACGCACATTTTCAAAAAGCTGTCGGCACAGAAAGTAGTTTAG
AAGCGGCTCTCAAAGAAGGTAAACTTTATCTATTAGACTATCCCACACTCTTTGATATTAAAGGTGGTACCTCT
CAAAACCTGAGAAAGTATTTACCTAAGCCGCAAGCTTTATTTTACTGGCAGAGCAACGGTTTACCAAATGGTG
GTTCCTTGCGTCCAGTAGCAATTAAATTAAATAATGATGCTGGGACAGATGGATTGATTTACACTCCTGATGAC
CCTTATCTAGATTGGTTTTTAGCAAAAACCTCTGTGCAGATTGCTGACGGAAACCATCAAGAATTAGGTAGTCA
TTTTGCTTATACTCATGCTGTTATGGCTCCTTTTTGTATTGCCACAGCACGCCAATTAGCAGCCAATCATCCCAT
TGCTTTACTACTAAAACCGCACTTCCGGTTTATGTTATTTGATAACGATTTAGGACGCACTCACTTTTTACAGCC
AGGTGGGCCAGTCGATGAATTTATGGCTGGTTCTTTGCAAGAGTCTTTAACTTTTGTCGTGAAAACTTATCAAG
AGTGGAGTGTCGAGAAATTTGTCTTCCCGACATTAATGAGAAATCAAAATATGGATGATCCAGAAATATTACC
GCATTTTCCCTTTCGAGATGATGGAATATTAATTTGGGATGCCATTCAAAAATTTGTTACAGACTATCTGCAACT
TTATTACCAAACTTCCCAAGATTTGAGCGAAGATTATGAATTACAAAATTGGGCAAGGGAATTAGTTGCTCAA
GATGGTGGTCGCGTTAAAGGAATGCCAGAAAAAATTGAAACCATAGACCAATTAATTCAAATTATCACGGTTG
TAATTTTCACTTGCGCTCCTTTCCACTCTGCTTTAAATTTTTCTCAGTACGAGTATATGGCTTTCGTACCGAATAT
GCCCTATGCAGCTTATCATCCAACGCCAGAAAAAAAGGGCGTGGATATGCAAACTATTATGAAGATATTACCA
CCTTTCAAGCAAGCTGCTGATCAAGTAATGTGGACACATATTTTAACATCGTACCACCACGACAAATTGGGGT
ATTACGATGAAGAATTTTCTGACCCATTGGCACAGGAATTAGTGATGCAATTCCAACAGAATTTGCATGATATA
GAACGAAAAATTGATATTAGAAATCAAACCCGTCCTATACCTTATAATTACCTCAAACCTTCGCAAATTATTAAC
AGTATCAATACTTGA

Amino acid Sequence for WP_103124384.1

SEQ ID NO: 122

MKPYLPQVDPNPNIRKDELVKNQADYKFNHNYLAPIPVIDKVPHQELFSAEYTAKRLASMANLAPNMLAAKARNF
LDPLDELEEYEELLTLLPKPAVMNNYKTDSCFAEQRLSGANPLAIQRIENLPENIGVTNAHFQKAVGTESSLEAALKE
GKLYLLDYPTLFDIKGGTSQNLRKYLPKPQALFYWQSNGLPNGGSLRPVAIKLNNDAGTDGLIYTPDDPYLDWFLAK
TSVQIADGNHQELGSHFAYTHAVMAPFCIATARQLAANHPIALLLKPHFRFMLFDNDLGRTHFLQPGGPVDEFMA
GSLQESLTFVVKTYQEWSVEKFVFPTLMRNQNMDDPEILPHFPFRDDGILIWDAIQKFVTDYLQLYYQTSQDLSED
YELQNWARELVAQDGGRVKGMPEKIETIDQLIQIITVVIFTCAPFHSALNFSQYEYMAFVPNMPYAAYHPTPEKKG
VDMQTIMKILPPFKQAADQVMWTHILTSYHHDKLGYYDEEFSDPLAQELVMQFQQNLHDIERKIDIRNQTRPIPY
NYLKPSQIINSINT

-continued

Coding sequence for BBD59026.1

SEQ ID NO: 123

ATGAAACCATATTTACCCCAGGTAGATCCTAATCCTAACATCCGCAAAGATGAGCTAGTCAAAAACCAAACAG
ATTATAAATTTAATCACAATTATCTAGCTCCTATTCCCGTTATAGATAAAGTCCCTCACCAAGAATTATTCTCCG
CAGAATATACGGCTAAACGCCTCGCTAGTATGGCAAATTTAGCACCAAATATGCTGGCTGCCAAAGCAAGAAA
TTTCCTTGACCCTTTAGATGAATTAGAAGAATACGAAGAACTATTAACGCTGCTACCTAAACCAGCAGTGATGA
ACAATTATAAAACAGACTCATGTTTTGCCGAGCAAAGATTATCAGGTGCGAACCCTTTAGCTATTCAAAGAATT
GATAGTTTACCAGAAAAGCTTGGAATAACAAACGCCCATTTTCAAAAATCTGTCGGGACAGAAAGTAGTTTAG
AAGCGGCTCTCAAAGAAGGTAAACTTTATTTATTAGACTATCCCACACTCTTTGATATTAAAGGTGGTATTTCTC
AAAACCTGAGAAAGTATTTACCTAAGCCGCAAGCTTTATTTTACTGGCAGAGCAACGGTTTACCAAATGGTGG
TTCCTTGCGTCCAGTAGCAATTAAATTAAATAATGATCCTGGGACAGATGGATTGATTTACACTCCTGATGATC
CTTATCTAGATTGGTTTTTAGCAAAAACCTCTGTGCAGATTGCTGACGGAAACCATCAAGAATTAGGTAGTCAT
TTTGCTTATACTCATGCTGTTATGGCTCCTTTTTGTATTGCCACAGCACGCCAATTAGCAGCCAATCATCCCATT
GCTTTACTACTAAAACCGCACTTCCGGTTTATGTTATTTGATAACGATTTAGGACGCACTCACTTTTTACAGCCA
GGTGGGCCAGTCGATGAATTTATGGCTGGTTCTTTGCAAGAGTCTTTAACTTTTGTCGTGAAAACTTATCAAGA
GTGGAGTGTCGAGAAATTTGTCTTCCCGACATTAATGAGAAATCAAAATATGGATGATCCAGAAATATTACCG
CATTTTCCCTTTCGAGATGATGGAATATTAATTTGGGATGCCATTCAAAAATTTGTTACAGACTATCTGCAACTT
TATTACCAAACTTCCCAAGATTTGAGCGAAGATTATGAATTACAAAATTGGGCAAGGGAATTAGTTGCTCAAG
ATGGTGGTCGCGTTAAAGGAATGCCAGAAAAAATTGAAACCGTAGACCAATTAATTCAAATTATCACGGTTGT
AATTTTCACCTGCGCTCCTTTCCACTCTGCTTTAAATTTTTCTCAGTACGAGTATATGGCTTTCGTACCGAATATG
CCCTATGCAGCTTATCATCCAACGCCAGAAAAAAAGGGCGTGGATATGCAAACGATTATGAAGATATTACCAC
CTTTCAAGCAAGCTGCTGATCAAGTAATGTGGACACATATTTTAACATCGTACCACCACGACAAATTGGGGTAT
TACGATGAAGAATTTGCTGACCCATTGGCACAGGAATTAGTGGTGCAATTCCAACAGAATTTGCATGATATAG
AACGAAAAATTGATATTAGAAATCAAACTCGTCCTATACCTTATGATTACCTCAAACCTTCGCAAATTATTAACA
GTATCAATACTTGA

Amino acid Sequence for BBD59026.1

SEQ ID NO: 124

MKPYLPQVDPNPNIRKDELVKNQTDYKFNHNYLAPIPVIDKVPHQELFSAEYTAKRLASMANLAPNMLAAKARNF
LDPLDELEEYEELLTLLPKPAVMNNYKTDSCFAEQRLSGANPLAIQRIDSLPEKLGITNAHFQKSVGTESSLEAALKEG
KLYLLDYPTLFDIKGGISQNLRKYLPKPQALFYWQSNGLPNGGSLRPVAIKLNNDPGTDGLIYTPDDPYLDWFLAKTS
VQIADGNHQELGSHFAYTHAVMAPFCIATARQLAANHPIALLLKPHFRFMLFDNDLGRTHFLQPGGPVDEFMAG
SLQESLTFVVKTYQEWSVEKFVFPTLMRNQNMDDPEILPHFPFRDDGILIWDAIQKFVTDYLQLYYQTSQDLSEDYE
LQNWARELVAQDGGRVKGMPEKIETVDQLIQIITVVIFTCAPFHSALNFSQYEYMAFVPNMPYAAYHPTPEKKGV
DMQTIMKILPPFKQAADQVMWTHILTSYHHDKLGYYDEEFADPLAQELVVQFQQNLHDIERKIDIRNQTRPIPYDY
LKPSQIINSINT

Coding sequence for WP_096579406.1

SEQ ID NO: 125

ATGAAACCATATTTACCCCAGGTAGATCCTAATCCTAACATCCGCAAAGATGAGCTATTCAAAAACCAAACAG
ATTATAAATTTAATCACAATTATCTAGCTCCTATTCCCGTTATAGATAAAGTCCCTCACCAAGAATTATTCTCCG
CAGAATATACGGCTAAACGCCTCGCTAGTATGGCAAATTTAGCACCAAATATGCTGGCTGCCAAAGCGAGAAA
TTTCCTTGACCCTTTAGATGAATTAGAAGAATACGAAGAACTATTAACGCTGCTACCTAAACCAGCAGTGATGA
ACAATTATAAAACAGACTCATGTTTTGCCGAGCAAAGATTATCAGGTGCGAACCCTTTAGCTATTCAAAGAATT
GAGAATTTACCAGAAAATATTGGAGTAACTAACGCACATTTTCAAAAAGCTGTCGGCACAGAAAGTAGTTTAG

-continued

AAGCGGCTCTCAAAGAAGGTAAACTTTATTTATTAGACTATCCCACACTCTTTGATATTAAAGGTGGTATTTCTC
AAAACCTGAGAAAGTATTTACCTAAGCCGCAAGCTTTATTTTACTGGCAGAGCAACGGTTTACCAAATGGTGG
TTCCTTGCGTCCAGTAGCAATTAAATTAAATAATGATGCTGGGACAGATGGATTGATTTACACTCCTGATGACC
CTTATCTAGATTGGTTTTTAGCAAAAACCTCTGTGCAGATTGCTGACGGAAACCATCAAGAATTAGGTAGTCAT
TTTGCTTATACTCATGCTGTTATGGCTCCTTTTTGTATTGCCACAGCACGCCAATTAGCAGCCAATCATCCCATT
GCTTTACTACTAAAACCGCACTTCCGGTTTATGTTATTTGATAACGATTTAGGACGCACTCACTTTTTACAGCCA
GGTGGGCCAGTCGATGAATTTATGGCTGGTTCTTTGCAAGAGTCTTTAACTTTTGTCGTGAAAACTTATCAAGA
GTGGAGTGTCGAGAAATTTGTCTTCCCGACATTAATGAAAAATCAAAATATGGATGATCCAGAAATATTACCG
CATTTTCCCTTTCGAGATGATGGAATATTAATTTGGGATGCCATTCAAAAATTTGTTACAGAATATCTGCAACTT
TATTACCAAACTTCCCAAGATTTGAGCGAAGATTATGAATTACAAAATTGGGCAAGGGAATTAGTTGCTCAAG
ATGGTGGTCGCGTTCAAGGAATGCCAGAAAAAATTGAAGCCGTAGACCAATTAATTCAAATTATCACGGTTGT
AATTTTCACCTGCGCTCCTTTCCACTCTGCTTTAAATTTTTCTCAGTACGAGTATATGGCTTTCGTACCGAATATG
CCCTATGCAGCTTATCATCCAACGCCAGAAAAAAAGGGCGTGGATATGCAAACTATTATGAAGATATTACCAC
CTTTCAAACAAGCTGCTGATCAAGTAATGTGGACACATATTTTAACATCGTACCACCACGACAAATTGGGGTAT
TACGATGAAGAATTTGCTGACCCATTGGCACAGGAATTAGTGGTGCAATTCCAACAGAATTTGCATGATATAG
AACGAAAAATTGATATTAGAAATCAAACTCGTCCTATACCTTATAATTACCTCAAACCTTCGCAAATTATTAACA
GTATCAATACTTGA

Amino acid Sequence for WP_096579406.1

SEQ ID NO: 126

MKPYLPQVDPNPNIRKDELFKNQTDYKFNHNYLAPIPVIDKVPHQELFSAEYTAKRLASMANLAPNMLAAKARNFL
DPLDELEEYEELLTLLPKPAVMNNYKTDSCFAEQRLSGANPLAIQRIENLPENIGVTNAHFQKAVGTESSLEAALKEG
KLYLLDYPTLFDIKGGISQNLRKYLPKPQALFYWQSNGLPNGGSLRPVAIKLNNDAGTDGLIYTPDDPYLDWFLAKTS
VQIADGNHQELGSHFAYTHAVMAPFCIATARQLAANHPIALLLKPHFRFMLFDNDLGRTHFLQPGGPVDEFMAG
SLQESLTFVVKTYQEWSVEKFVFPTLMKNQNMDDPEILPHFPFRDDGILIWDAIQKFVTEYLQLYYQTSQDLSEDYE
LQNWARELVAQDGGRVQGMPEKIEAVDQLIQIITVVIFTCAPFHSALNFSQYEYMAFVPNMPYAAYHPTPEKKGV
DMQTIMKILPPFKQAADQVMWTHILTSYHHDKLGYYDEEFADPLAQELVVQFQQNLHDIERKIDIRNQTRPIPYNY
LKPSQIINSINT

Coding sequence for WP_019504688.1

SEQ ID NO: 127

ATGAAGAATAAGTCAAAAACAAATGTCGGAGAAAAAATGGCTATTTTTTCTCCCGCATTAAGCGAAGACGAAT
TAGCACAACGCACTCAATACTTAAAATTTCAACAACAGGAATATGAGTTTACTCATGAATACGTAGAAGGTCTA
AGTTTATTTAAAGAAGTTCCTGTTCAAGAAGGCTTTTCAACTGCTTATCTTGCCGATAGAGAATTCCAGCTATC
AGCGATATCAATCAATATGTTAGCAGTCGAACCACGTCCTTTTCTTGACCCTTTGGAAACATTAGGAGATTACG
AAAATTTTTATAAGATTATCCGAAAACCTGGTGTTGCCAACATTTATCAAACAGATCGTGCTTTTGCCGAACAA
AGATTGTCTGGGGTTAATCCCTTGGTCATTAAAAAATTTACCGAAATGCCTGCTGGTGTTGATATTTCTTTACA
AGATTTAGGTCAAGAAACTCAAGTTTTATTCAGCTCCAGCGCAACTAATTTGCAAGCAGAAATTCAACGAGGA
CATATCTTCGTTGCCGACTATACAGAAAGTTTGTCTTTTGTTGAAGGTGGAACTTACGAAAAAGGACGTAAGT
ATTTACCAAAACCAATCGCTTTTTTCTGGTGGCGTAAAGATGGCATTAAAGATCGCGGTGAATTAGTCCCCATT
GCTATTGCGATCGAGTTAAATACTGCGGATAAAAAATGGAAAATCTTGATACCCAGGGACAAAGATTTGCACT
GGACAGCTGCCAAACTTTGCGTGCAAATTGCTGATGCCAATCATCATGAAATGAGTACTCATTTAGGGCGTAC
GCATCTTGTAATGGAACCTTTTGCGGTCAGTACTGCCAGACAATTAGCTAAAAATCATCCTTTAGGATTGCTTT
TGCGCCAACACTTTCGCTTTATGATAGCGATTAATGATATGGCTCGCAGAGAGTTGATTAATCCAGGTGGTTTT
GTAGAAGCAGCACTTGCAGGAACATTGCCAGAATCTCTACGAATTGTTAAAAATGCTTGTGTTAGTTGGAATA

-continued

TTAAAGATTTTGCCTTTCCCACGGAGCTCAAAAATCGTGGTATGGATGAAAAAGACGATCGAGATAATTACAA

ATTACCCCACTATCCCTACCGCGATGATGGTTTAATGCTTTGGAATGCGATCGAGGATTTTGTAACTGGTTATC

TTAAGATCTTTTATCCCAAACCTGAGGATATTCAAAGCGATCGAGAATTACAACAATGGGCAGCAGAATTAGC

ATCTGCCGATGGTGGAAAAGTTGCCAAAATGCCCGAAAAAATTAGTGATATTGAGGAACTAATCGAAATTATT

ACCACTATTATTTTTATTTGTGGTCCTCAACATTCGGCGGTGAATTTTCCCCAATATGAATATATTGGTTTTATAC

CTAATATGCCTCTAGCTGCTTATCAAGAAATTACTGGAGCAGAAGATCAATTTAAAGAGGAACGAGATCTGCT

ACAACTTTTACCTCCTCTAAAACAAACAGCGACTCAATTACTGACGATGTATAACCTTTCAACTTATCATTACGA

TCGCCTGGGTTATTATGACGAAGAGTTTGAAAATACGGTTAAAGGTACAGACATTGAACCGATAGTTGCCAAA

TTCAAACAAGATTTGAATCAAATAGAAGTAGAGATTGATAATAAGAATAAAGATCGTACTATTCCCTATCCGTT

TCTAAAGCCTTCCTTAGTTTTAAACAGTATTTGTATCTAA

Amino acid Sequence for WP_019504688.1

SEQ ID NO: 128

MKNKSKTNVGEKMAIFSPALSEDELAQRTQYLKFQQQEYEFTHEYVEGLSLFKEVPVQEGFSTAYLADREFQLSAISI

NMLAVEPRPFLDPLETLGDYENFYKIIRKPGVANIYQTDRAFAEQRLSGVNPLVIKKFTEMPAGVDISLQDLGQETQ

VLFSSSATNLQAEIQRGHIFVADYTESLSFVEGGTYEKGRKYLPKPIAFFWWRKDGIKDRGELVPIAIAIELNTADKK

WKILIPRDKDLHWTAAKLCVQIADANHHEMSTHLGRTHLVMEPFAVSTARQLAKNHPLGLLLRQHFRFMIAIND

MARRELINPGGFVEAALAGTLPESLRIVKNACVSWNIKDFAFPTELKNRGMDEKDDRDNYKLPHYPYRDDGLML

WNAIEDFVTGYLKIFYPKPEDIQSDRELQQWAAELASADGGKVAKMPEKISDIEELIEIITTIIFICGPQHSAVNFPQYE

YIGFIPNMPLAAYQEITGAEDQFKEERDLLQLLPPLKQTATQLLTMYNLSTYHYDRLGYYDEEFENTVKGTDIEPIVA

KFKQDLNQIEVEIDNKNKDRTIPYPFLKPSLVLNSICI

Coding sequence for OCQ98836.1

SEQ ID NO: 129

ATGAAACCATACTTACCCCAGGTAGACCCTAACCCAAACATTCGTAAAGATGAGCTAGTAAAAAATCGAGAAG

ATTATAAATTTAATCATGATTACCTAGCTCCTATTCCTGTTATTGATAAAGTCCCCCATAAAGAACTCTTCTCGG

CAGAATATACAGCTAAACGCCTCGCAAGTATGGCTAATTTAGCACCAAATATGTTAGCCGCCAAAGCCAGAAA

TTTTCTTGACCCTTTAGATGAATTAGAAGAATACGAAGAACTGTTGACACTGCTACCTAAACCAGCAGTAATGA

ATAATTATAAAACCGATTCATGTTTTGCCGAGCAAAGATTATCAGGTGCGAACCCTTTAGCAATACGCAGAATT

GATAGTTTACCAGCAAATCTCGGTATCACCAACGCCCATTTTCAAAAATCTGTCGGCACAGAAAGTAACTTAGA

AGCGGCTCTCAAAGAAGGTAAACTTTATCTATTAGATTATCCTACACTCTTTGATATTAAAGGTGGAACTTCTC

AAAATGTGAGAAAGTATTTACCTAAGCCTCAAGCTTTATTTTACTGGCAGAGCAATGGTGTAGCAAATGGTGG

TTCTCTCCGTCCAGTGGCGATTAAATTAAATAATGATGCTGGTACAGATGGATTGATTTACACTCCCGATGACC

CTTATTTAGATTGGTTTTTAGCAAAAACTTCTGTGCAGATAGCTGACGGAAATCATCAAGAATTAGGTAGTCAT

TTTGCATATACTCATGCTGTTATGGCTCCATTTTGTATCGCCACAGCACGCCAATTAGCAGCAAATCATCCCATC

GCTTTACTACTAAGACCGCACTTCCGGTTCATGTTATTTGATAACGATTTAGGACGCACTCATTTTCTACAACCA

GGTGGCCCAGTCGATGAATTTATGGCTGGTTCTTTAGAAGAATCATTAACTTTTGTCGTCAAAACTTACCAAGA

ATGGAGTGTTGATAAATTTGTCTTCCCGACATTAATGAAAAGTCAAAACATGGATGACCCAGATATATTACCG

CATTTTCCGTTCCGGGATGATGGTATATTGATTTGGAATGCCATTCATAAATTTGTCACAGATTATTTGCAACTT

TATTACAAAACACCTCAAGACTTAAGCGAAGATTATGAATTGCAAAATTGGGCAAGAGAATTAGTTGCTCAAG

ATGGTGGACGGGTTAAAGGAATGCCAGAGAAAATTGAAACTATCGACCAATTAATTCAAGTTATTACGGTTAT

AGTTTTTACCTGCGCTCCTTTCCATTCGGCTTTAAATTTTGCCCAGTACGAATACATGGCTTTCGTGCCGAATAT

GCCTTATGCAGCTTATCATCCAACTCCCGAAAGTAAGGGTGTGGATATGCAAACCATCATGAAACTATTGCCA

CCATTCAAGCAAGCTGCTGACCAAGTAATGTGGACACATATTTTAACATCTTACCATTACGATAAATTGGGTTA

-continued

TTACGATGAAGAATTTGCCGACCCATTGGCACAGGAATTAGTTGTACAGTTCCAACAGAATTTACATGATATA
GAACGACAAATTGATATTAGAAATCAAACTCGTCCTATACCTTATAATTTCCTCAAACCTTCCCAAATTATTAAC
AGTATCAATACTTAA

Amino acid Sequence for OCQ98836.1

SEQ ID NO: 130

MKPYLPQVDPNPNIRKDELVKNREDYKFNHDYLAPIPVIDKVPHKELFSAEYTAKRLASMANLAPNMLAAKARNFL
DPLDELEEYEELLTLLPKPAVMNNYKTDSCFAEQRLSGANPLAIRRIDSLPANLGITNAHFQKSVGTESNLEAALKEG
KLYLLDYPTLFDIKGGTSQNVRKYLPKPQALFYWQSNGVANGGSLRPVAIKLNNDAGTDGLIYTPDDPYLDWFLAK
TSVQIADGNHQELGSHFAYTHAVMAPFCIATARQLAANHPIALLLRPHFRFMLFDNDLGRTHFLQPGGPVDEFMA
GSLEESLTFVVKTYQEWSVDKFVFPTLMKSQNMDDPDILPHFPFRDDGILIWNAIHKFVTDYLQLYYKTPQDLSEDY
ELQNWARELVAQDGGRVKGMPEKIETIDQLIQVITVIVFTCAPFHSALNFAQYEYMAFVPNMPYAAYHPTPESKG
VDMQTIMKLLPPFKQAADQVMWTHILTSYHYDKLGYYDEEFADPLAQELVVQFQQNLHDIERQIDIRNQTRPIPY
NFLKPSQIINSINT

Coding sequence for WP_062293357.1

SEQ ID NO: 131

ATGAAACCATACTTACCCCAGGTAGACCCTAACCCAAACATCCGTAAAGATGAGCTAGTAAAAAATCGAGAAG
ATTATAAATTTAATCATGATTATTTAGCTCCTATTCCTGTTATTGATAAAGTCCCCCATCAAGAACTATTTTCGGC
AGAATATACAGCTAAACGCCTCGCCAGCATGGCAAATTTAGCACCAAATATGTTAGCTGCCAAAGCCAGAAAT
TTTCTTGATCCTTTAGATGAATTAGAAGAATACGAAGAACTGTTGACACTGCTACCTAAACCAGCAGTGATGA
ACAATTATAAGACCGATTCATGTTTTGCCGAGCAAAGATTATCAGGTGCTAACCCTTTAGCAATTCGGAGAATT
GATAGTTTACCAGCAAATCTAGGCATCACAAATGCCCATTTTCAAAAATCTGTCGGGACAGAAAGTAACTTGG
AAGCGGCTCTCAAAGAAGGTAAACTTTATCTATTAGATTATCCTGCACTTTTTGATATTAAAGGTGGAACTTCT
CAAAATGTGAGAAAGTATTTACCTAAGCCTCAAGCTTTATTTTACTGGCAGAGCAATGGTGTAGCAAATGGTG
GTTCGCTCCATCCAGTGGCGATTAAATTAAATAATGATGCTGGGACAGATGGATTGATTTACACTCCCGATGA
CCCTTATCTAGATTGGTTTTTAGCAAAAACTTCTGTACAGATTGCTGACGGCAACCATCAAGAATTAGGTAGTC
ATTTTGCCTATACTCATGCTGTTATGGCTCCTTTTTGTATTGCCACAGCACGCCAATTAGCCGCAAATCATCCCA
TTGCTTTACTACTAAAACCACATTTCCGGTTCATGTTATTTGATAACGATTTGGGACGCACTCATTTCTTACAGC
CAGGTGGCCCAGTCGATGAATTTATGGCTGGTTCTTTAGAAGAATCATTAACTTTTGTCGTCAAAACTTACCAA
GAATGGAGTGTTGATAAATTTGTCTTCCCGACATTAATGAAAAGTCAAAACATGGATGACCCAGATGTATTAC
CACATTTTCCGTTCCGGGATGATGGGATGTTGATTTGGAATGCCATTCATAAATTTGTCACAGATTATTTGCAA
CTTTATTACAAAACTTCCCAAGACTTAAGCGAAGATTATGAATTGCAAAATTGGGCAAGAGAATTAGTTGCTC
AAGATGGTGGACGGGTTAAAGGAATGCCGGACAAAATTGAAACTATCGACCAATTAATTCAAATTATTACGGT
TGTAGTTTTTACCTGCGCTCCTTTCCATTCTGCTTTAAATTTTTCCCAGTACGAATACATGGCTTTCGTACCAAAT
ATGCCTTATGCAGCTTATCATCCCACTCCTGAAAGTAAAGGTGTGGATATGCAAACTATCATGAAGATATTGCC
ACCATTTAAGCAAGCTGCTGACCAAGTAATGTGGACGCATATTTTAACATCTTACCATTACGATAAATTAGGTT
ATTATGATGAGGAATTTGCCGACCCATTAGCACAGGAATTAGTTGTGCAGTTCCAACAGAATTTACATGATAT
AGAACGAAAAAATTGATATTAGAAATCAAACTCGTCCTATACCGTATAATTTCCTCAAACCTTCCCAAATTATTAA
CAGTATCAATACTTAA

Amino acid Sequence for WP_062293357.1

SEQ ID NO: 132

MKPYLPQVDPNPNIRKDELVKNREDYKFNHDYLAPIPVIDKVPHQELFSAEYTAKRLASMANLAPNMLAAKARNFL
DPLDELEEYEELLTLLPKPAVMNNYKTDSCFAEQRLSGANPLAIRRIDSLPANLGITNAHFQKSVGTESNLEAALKEG
KLYLLDYPALFDIKGGTSQNVRKYLPKPQALFYWQSNGVANGGSLHPVAIKLNNDAGTDGLIYTPDDPYLDWFLAK
TSVQIADGNHQELGSHFAYTHAVMAPFCIATARQLAANHPIALLLKPHFRFMLFDNDLGRTHFLQPGGPVDEFMA

-continued

GSLEESLTFVVKTYQEWSVDKFVFPTLMKSQNMDDPDVLPHFPFRDDGMLIWNAIHKFVTDYLQLYYKTSQDLSE

DYELQNWARELVAQDGGRVKGMPDKIETIDQLIQIITVVVFTCAPFHSALNFSQYEYMAFVPNMPYAAYHPTPES

KGVDMQTIMKILPPFKQAADQVMWTHILTSYHYDKLGYYDEEFADPLAQELVVQFQQNLHDIERKIDIRNQTRPIP

YNFLKPSQIINSINT

Coding sequence for WP_104398120.1

SEQ ID NO: 133

ATGCTGACACCATCGCTCCCAAAAAATGATTCTGATCCAGTCAAAAGACAAGATCTATTAAGACGACAAAAAC

AAGTGTACATTTATGATTCCGTTAATGGTATCACCCTCGTCAAAGATTTACCTACCCACGAAAACTTTTCTATTT

CCTATCAAGTAATGCGGGGTAAAGGTTTCAGTGCTTTAATTGCCAATGGCGTAGCCACGAGAATAGAAAATGT

CTTTGATCCCTTCGACAAATTAGAAGATTACGAAGAACTTTTTCCTATCCTTCCCAAACCCACAAGCATTAAAAC

TTGGCAATCTAACACAGGTTTTGCCTACCAAAGATTAGCGGGAGCAAATCCCATGGTAATTCGCGGGATTAGC

AGCTTACCAAATAATTTCCCCGTCAGCGATACTATCTTCCAAAAAGCCATGGGACCGGATAAAACCATTGCCTC

GGAAGCCGCTAAGGGTAACTTATTTCTAGCAGATTATGCACCCCTAAACAACCTAACTTTAGGCAGTTATCAAC

GGGGGATGAAAGCTGTGACAGCACCTCTTGTCCTTTTCTGTTGGCGTGCTAGAGGTTTACGCGGTCAAGGGG

GATTAGTACCAGTTGCCATTCAATTGTATCAAGATCCGACCCAACCTAATCAGCGCATCTATACCCCCGATGAC

GGACTTAATTGGTTAATGGCGAAGATTTTCGTGCAAATTGCCGACGGAAACCACCATGAATTAGTTAGTCACC

TCAGCCATACCCATTTAGTAGCGGAAGCTTTTGTTTTAGCCACAGCTACCGAGTTAGCACTCAATCATCCTCTG

GCAATTCTATTAAGACCTCATTTTCAATTTACCCTCGCCATTAATAGTTTAGCCGAGAGCGAGTTAATTAACCCC

GGCGGATTTGTTGATCGTCTATTAGCGGGGACGCTAGAAGCATCGATCGAGCTAATTAAGAGTTCCTATCGTC

AAAGATTAGATAATTTCGCCGATTATGCCCTACCAAAGGAATTAGCATTGCGCCAAGTCCAGGATACCTCGCT

ACTACCAGATTACCCCTACCGAGACGATGCTCTCTTACTTTGGCAAGCAACGGAAACCTACGTCAAAGATTACC

TAAGTCTTTACTATACTTCCGACGCGGATGTAAACGGGGATACAGAATTACAAGCTTGGGCGCGAAAATTGAT

GTCACCTGAAGGTGGAGGCATCAAAAAATTAGTTTTTGACGGACAATTAGACACTTTAGCCAAATTAGTCGAA

GTTGTCACCCAGATAATTTTTGTGGCCGGACCACAACACGCGGCGGTTAATTATCCTCAATACGATTATCTCGC

CTTTTGCCCGAATATTCCCCTAGCGGGTTATCAATCCCCTCCCAAAGCAGCTGAAGAGGTGGATATAGATTATA

TTCTCCGTCTTTTGCCGCCCCAGGCCCAGGCCGCTTATCAATTGGAAATTATGCAGACTTTAACAGCTTTTCAAT

TTAACCGTTTTGGTTATCCATCCCGAAGTGCTTTCCCAGATCAACGCACTTACCCGATTTTGGCGGTTTTCCAAG

CTAAATTAAAAGCGATCGAAAATCAGATCGATCGGCGCAATTTAACCCGATTTACGCCTTATATTTTCCTGAAA

CCCTCTCGCATCCCCAATAGTATCAATATTTAG

Amino acid Sequence for WP_104398120.1

SEQ ID NO: 134

MLTPSLPKNDSDPVKRQDLLRRQKQVYIYDSVNGITLVKDLPTHENFSISYQVMRGKGFSALIANGVATRIENVFDP

FDKLEDYEELFPILPKPTSIKTWQSNTGFAYQRLAGANPMVIRGISSLPNNFPVSDTIFQKAMGPDKTIASEAAKGNL

FLADYAPLNNLTLGSYQRGMKAVTAPLVLFCWRARGLRGQGGLVPVAIQLYQDPTQPNQRIYTPDDGLNWLMA

KIFVQIADGNHHELVSHLSHTHLVAEAFVLATATELALNHPLAILLRPHFQFTLAINSLAESELINPGGFVDRLLAGTLE

ASIELIKSSYRQRLDNFADYALPKELALRQVQDTSLLPDYPYRDDALLLWQATETYVKDYLSLYYTSDADVNGDTELQ

AWARKLMSPEGGGIKKLVFDGQLDTLAKLVEVVTQIIFVAGPQHAAVNYPQYDYLAFCPNIPLAGYQSPPKAAEEV

DIDYILRLLPPQAQAAYQLEIMQTLTAFQFNRFGYPSRSAFPDQRTYPILAVFQAKLKAIENQIDRRNLTRFTPYIFLKP

SRIPNSINI

Coding sequence for WP_002758835.1

SEQ ID NO: 135

ATGCTGACACCATCGCTACCCAAAAATGATCCTGATCCAGTCAAAAGACAAGATCTATTAAGACGACAAAAAC

AAGTGTACATTTATGATTCCGTTAATGGTATCACCCTCGTCAAAGATTTACCTACCCACGAAAACTTTTCTATTT

-continued

CCTATCAAGTAATGCGGGGTAAAGGTTTCAGTGCTTTAATTGCCAATGGAGTCGCCACAAGAGTAGAAAATAT

CTTCGATCCCTTCGACACATTAGAAGATTACGAAGAACTTTTTCCTATCCTTCCCAAACCCACAAGCATTAAAAC

TTGGCAATCTAATACAGGTTTTGCCTACCAAAGATTAGCGGGAGCAAATCCCCTGGTAATTCGCGGGATTAGC

AGCTTACCAGATAATTTCCCCGTCAGCGATGCCATCTTCCAAAAAGCCATGGACCGGATAAAACCATTGACT

CGGAAGCCGCTAAGGGTAACTTATTTCTAGCAGATTATGCCCCCCTAAACAACCTAACTTTAGGCAGTTATCAA

AAGGGCATGAAAACTGTAACAGCACCTCTTGTCCTTTTCTGTTGGCGTGCTAGAGGTTTACGCGGTCAAGGGG

GATTAGTACCTGTTGCCATTCAATTATATCAGGATCCGACCCAACCTAATCAGCGCATCTATACCCCCGATGAC

GGACTTAATTGGTTAATGGCGAAGATTTTCGTGCAAATTGCCGACGGAAATCACCATGAATTAGTTAGTCACC

TCAGCCATACCCATTTAGTAGCGGAAGCTTTTGTTTTAGATACAGCTACCGAGTTAGCAATCAATCATCCTCTG

GCAATTCTATTAAGACCTCATTTTCAATTTACCCTCGCTATTAATAGTTTAGCCGAGAGCGAGTTAATTAACCCT

GGCGGATTCGTTGATCGTCTATTAGCGGGGACGCTAGAAGCATCTATCGAGATAATTAAGACTTCCTATCGTC

AAAGATTGGATAATTTCGCCGATTATACCCTACCCAAGCAATTAGCCTTCCGCCAAGTCGATGATACCTCCCTA

CTACCAGATTACCCCTACCGAGACGATGCTCTCTTACTTTGGCAAGCAACGGAAACCTACGTCAAAGATTACCT

AAGTCTTTACTATACTTCCGACGCGGATGTAAACGGGGATACAGAATTACAAGCTTGGGTGCGAAAATTGATG

TCACCTGAAGGTGGAGGCATCAAAAAATTAGTTTCTGACGGAGAATTAGACACTTTAGCCAAATTAGTCGAAG

TTGTCACCCAGATAATTTTTGTGGCCGGACCACAACACGCGGCGGTTAATTATCCTCAATACGATTATCTCGCC

TTTTGCCCGAATATTCCCCTAGCGGGTTATCAATCTCCTCCCAAAGCAGCTGAGGAGGTGGATATAGATTATAT

TCTCCGTCTTTTGCCGCCCCAGTCCCAGGCCGCTTATCAATTGGAAATTATGCAGACTTTAACAGCTTTTCAATT

TAACCGTTTTGGCTATCCATCCCGAAGTGCTTTCCCAGATCAACGCACTTACCCGATTTTGGCGGTTTTCCAAGC

TAAATTAAAGGCGATCGAAAATGAGATCGATCGGCGCAATTTAACCCGATTTACGCCTTATATTTTCCTGAAAC

CCTCTCGCATCCCCAATAGTATCAATATTTAG

Amino acid Sequence for WP_002758835.1

SEQ ID NO: 136

MLTPSLPKNDPDPVKRQDLLRRQKQVYIYDSVNGITLVKDLPTHENFSISYQVMRGKGFSALIANGVATRVENIFDP

FDTLEDYEELFPILPKPTSIKTWQSNTGFAYQRLAGANPLVIRGISSLPDNFPVSDAIFQKAMGPDKTIDSEAAKGNLF

LADYAPLNNLTLGSYQKGMKTVTAPLVLFCWRARGLRGQGGLVPVAIQLYQDPTQPNQRIYTPDDGLNWLMAKI

FVQIADGNHHELVSHLSHTHLVAEAFVLDTATELAINHPLAILLRPHFQFTLAINSLAESELINPGGFVDRLLAGTLEAS

IEIIKTSYRQRLDNFADYTLPKQLAFRQVDDTSLLPDYPYRDDALLLWQATETYVKDYLSLYYTSDADVNGDTELQA

WVRKLMSPEGGGIKKLVSDGELDTLAKLVEVVTQIIFVAGPQHAAVNYPQYDYLAFCPNIPLAGYQSPPKAAEEVDI

DYILRLLPPQSQAAYQLEIMQTLTAFQFNRFGYPSRSAFPDQRTYPILAVFQAKLKAIENEIDRRNLTRFTPYIFLKPSR

IPNSINI

Coding sequence for WP_072927101.1

SEQ ID NO: 137

ATGCTGACACCATCGCTACCCCAAAATGATCCTGATCCAGCCAAAAGACAAGAGCTATTAAGACGACAAAAAC

AAGTGTACATCTATGATTCCGTTAATGGTATCACCCTCGTCAAAGATTTACCTACCCACGAAAACTTTTCTATTT

CCTATCAAGTAATGCGGGGTAAAGGTTTCAGTGCTTTAATTGCCAATGGCGTGGCCACGAGAATAGAAAACG

TCTTTGATCCCTTCGACAAATTAGAAGATTACGAAGAACTTTTTCCCATCCTTCCCCAACCCACAAGCATTAAAA

CTTGGCAATCTAACACAAGTTTTGCCTACCAAAGATTAGCGGGAGCAAATCCCATGGTCATCCGCGGGATTAG

CAGCTTACCGGATAATTTTCCCGTCAGCGATGCTATCTTCCAAAAAGCCATGGGACCTGATAAAACCATTGCCT

CGGAAGCCGCTAAGGGTAACTTATTTCTAGCAGATTATGCCCCCCTAAACAACCTAACTTTAGGCAGTTATCAA

AAGGGTATGAAAACTGTAACAGCACCTCTTGTCCTTTTCTGTTGGCGTGCTAGAGGTTTACGGGGTCAAGGGG

GATTAGTACCAGTTGCCATTCAATTATATCAAGATCCGACTCAACCTAATCAGCGCATCTATACCCCCGATGAC

GGACTTAATTGGTTAATGGCGAAAATTTTCGTCCAAATTGCCGACGGAAATCACCATGAATTAGTTAGTCACCT

-continued

CAGCCATACCCATTTAGTAGCGGAAGCTTTTGTTTTAGCCACAGCTACCGAGTTAGCACTTAATCATCCTCTGG

CAATTCTATTAAGACCTCATTTTCAATTTACCCTCGCTATTAATAGTTTAGCCGAGAGCGAGTTAATTAACCCCG

GCGGATTCGTTGATCGTCTATTAGCGGGGACGCTAGAAGCATCGATCGAGCTAATTAAGAGTTCCTATCGTCA

AAGATTAGATAATTTCGCCGATTATGCCCTACCAAAGCAATTAGAATTGCGCCAAGTCCAGGATACCTCGCTAC

TACCAGATTACCCCTACCGAGACGATGCTCTCTTACTTTGGCAAGCAACGGAAACCTACGTCAAAGATTACCTA

AGTCTTTACTATACTTCCGATGCGGACGTAAATGAGGATACAGAATTACAAGCTTGGGTGCGAACATTGATGT

CACCTGAAGGTGGAGGCATCAAAAAATTAGTTTCTGAAGGAGAATTAGACACTTTGGCCAAATTAATCGAAGT

TGTCACCCAGATAATTTTTGTGGCCGGACCACAACACGCGGCGGTTAATTATCCTCAATACGATTATCTCGCCT

TTTGCCCGAATATTCCCCTAGCGGGTTATCAATCTCCTCCCAAAGCAGCTGAGCAGGTGGATATAGATTATATT

CTCCGTCTTTTGCCCCCCCAGGCCCAGGCCGCTTATCAATTGGAAATTATGCAGACTTTAACAGCTTTTCAATTT

AACCGTTTTGGCTATCCATCCCGAAGTGCTTTCCCAGATCAACGCACTTACCCGATTTTGGCGGTTTTCCAAGCT

AAATTAAAGGCGATCGAAAATCAGATCGATCGGCGCAATTTAACCCGATTTACGCCTTATATTTTCCTGAAACC

CTCTCGCATCCCCAATAGTATCAATATTTAG

Amino acid Sequence for WP_072927101.1

SEQ ID NO: 138

MLTPSLPQNDPDPAKRQELLRRQKQVYIYDSVNGITLVKDLPTHENFSISYQVMRGKGFSALIANGVATRIENVFDP

FDKLEDYEELFPILPQPTSIKTWQSNTSFAYQRLAGANPMVIRGISSLPDNFPVSDAIFQKAMGPDKTIASEAAKGNL

FLADYAPLNNLTLGSYQKGMKTVTAPLVLFCWRARGLRGQGGLVPVAIQLYQDPTQPNQRIYTPDDGLNWLMAK

IFVQIADGNHHELVSHLSHTHLVAEAFVLATATELALNHPLAILLRPHFQFTLAINSLAESELINPGGFVDRLLAGTLEA

SIELIKSSYRQRLDNFADYALPKQLELRQVQDTSLLPDYPYRDDALLLWQATETYVKDYLSLYYTSDADVNEDTELQA

WVRTLMSPEGGGIKKLVSEGELDTLAKLIEVVTQIIFVAGPQHAAVNYPQYDYLAFCPNIPLAGYQSPPKAAEQVDI

DYILRLLPPQAQAAYQLEIMQTLTAFQFNRFGYPSRSAFPDQRTYPILAVFQAKLKAIENQIDRRNLTRFTPYIFLKPS

RIPNSINI

Coding sequence for WP_110578596.1

SEQ ID NO: 139

ATGCTGACACCATCGCTACCCAAAAATGATCCTGATCCAGTCAAAAGACAAGATCTATTAAGACGACAAAAAC

AAGTGTACATCTATGATTCCGTTAATGGTATCACCCTCGTCAAAGATTTACCTACCCACGAAAACTTTTCTATTT

CCTATCAAGTAATGCGGGGTAAAGGTTTCAGTGCTTTAATTGCCAATGGCGTAGCCACGAGAATAGAAAATGT

CTTTGATCCCTTTGATAAATTAGAAGATTACGAAGAACTTTTTCCTATCCTTCCCAAACCCACAAGTATTAAAAC

TTGGCAATCTAACACAGGTTTTGCCTACCAAAGATTAGCGGGAGCAAATCCCATGGTAATTCGCGGTATTAGC

AGCTTACCGGATAATTTTCCCGTCAGCGATGCCATCTTCCAAAAAGCCATGGGACCGGATAAAACCATTGCCTC

GGAAGCTGCTAGGGGTAACTTATTTCTAGCAGATTATGCCCCCCTAAACAACCTAACTTTAGGCAATTATCAAA

GGGGGATGAAAGCTGTGACAGCACCTCTTGTCCTTTTCTGTTGGCGTGCTAGAGGTTTACGTGGTCAAGGGG

GATTAGTACCGGTTGCCATTCAATTATATCAGGATCCTACCCAACCTAATCAGCGCATCTATACTCCCGATGAC

GGACTTAATTGGTTAATGGCGAAGATTTTCGTGCAAATTGCCGACGGAAACCACCATGAATTAGTTAGTCACC

TCAGCCATACCCATTTAGTAGCGGAAGCTTTTGTTTTAGCCACAGCTACCGAGTTAGCACTCAATCATCCTCTG

GCGATTCTATTAAGACCTCATTTTCAATTTACCCTCGCCATTAATAGTTTAGCCGAGAGCGAGTTAATTAACCCA

GGCGGATTTGTTGATCGTCTATTAGCGGGGACGCTAGAGGCATCGATCGAGCTAATTAAGAGTTCCTATCGTC

AAAGATTAGATAATTTCGCCGATTATGCCCTACCAAAGCAATTAGAATTGCGCCAAGTCCAGGATACCTCGCT

ACTACCAGATTACCCCTACCGAGACGATGCTCTCTTACTTTGGCAAGCAACGGAAACCTACGTCAAAGATTACC

TAAGTCTTTACTATACTTCCGACGCGGACGTAAACGAGGATACAGAATTACAAGCTTGGGTGCGAAAATTGAT

GTCACCTGAAGGTGGAGGCATCAAAAAATTAGTTTCTGACGGACAATTAGACACTTTAGCCAAATTAATCGAA

-continued

GTTGTCACCCAGATAATTTTTGTGGCCGGACCACAACACGCGGCGGTTAATTATTCTCAATACGATTATCTCGC
CTTTTGCCCGAATATTCCCCTAGCGGGTTATCAATCTCCTCCCAAAGCAGCTGAGGAGGTGGATATAGATTATA
TTCTCCGTCTTTTGCCGCCCCAGGCCCAGGCCGCTTATCAATTGGAAATTATGCAGACTTTAACAGCTTTTCAAT
TTAACCGTTTTGGTTATCCATCCCGCAGTGCTTTCCCAGATCAACGCACTTACCCGATTTTGGCGGTTTTCCAAG
CTAAATTAAAAGCGATCGAAAATGAGATCGATCGGCGCAATTTAACCCGATTTACGCCTTATATTTTCCTGAAA
CCCTCTCGCATCCCCAATAGTATCAATATTTAG

Amino acid Sequence for WP_110578596.1

SEQ ID NO: 140

MLTPSLPKNDPDPVKRQDLLRRQKQVYIYDSVNGITLVKDLPTHENFSISYQVMRGKGFSALIANGVATRIENVFDP
FDKLEDYEELFPILPKPTSIKTWQSNTGFAYQRLAGANPMVIRGISSLPDNFPVSDAIFQKAMGPDKTIASEAARGNL
FLADYAPLNNLTLGNYQRGMKAVTAPLVLFCWRARGLRGQGGLVPVAIQLYQDPTQPNQRIYTPDDGLNWLMA
KIFVQIADGNHHELVSHLSHTHLVAEAFVLATATELALNHPLAILLRPHFQFTLAINSLAESELINPGGFVDRLLAGTLE
ASIELIKSSYRQRLDNFADYALPKQLELRQVQDTSLLPDYPYRDDALLLWQATETYVKDYLSLYYTSDADVNEDTELQ
AWVRKLMSPEGGGIKKLVSDGQLDTLAKLIEVVTQIIFVAGPQHAAVNYSQYDYLAFCPNIPLAGYQSPPKAAEEV
DIDYILRLLPPQAQAAYQLEIMQTLTAFQFNRFGYPSRSAFPDQRTYPILAVFQAKLKAIENEIDRRNLTRFTPYIFLKP
SRIPNSINI

Coding sequence for WP_045360762.1

SEQ ID NO: 141

ATGCTGACACCATCGCTACCCCAAAATGATCCTGATCCAGCCAAAAGACAAGATCTATTAAGACGACAAAAAC
AAGTGTACATTTATGATTCCGTTAATGGTATCACCCTCGTCAAAGATTTACCTACCCACGAAAACTTTTCTATTT
CCTATCAAGTAATGCGGGGTAAAGGTTTCAGTGCTTTAATTGCCAATGGAGTCGCCACAAGGGTAGAAAATAT
CTTCGATCCCTTTGATAAATTAGAAGATTACGAAGAACTTTTTCCCCTCCTTCCCCAACCCACAAGCATTAAAAA
TTGGCAATCTAACACAAGTTTTGCCTACCAAAGATTAGCGGGAGCAAATCCCATGGTCATCCGGGGGATTAGC
AGCTTACCGGATAATTTCCCAGTCACCGATGCTATCTTCCAAAAAGCTATGGGACCGGATAAAACCATTGCCTC
GGAAGCCGCTAAGGGTAACTTATTTCTAGCAGATTATGCCACCCTACACCACCTAACTTTAGGCAGTTATCAAA
GGGGTATGAAAACTGTGACAGCACCTCTTGTCCTTTTCTGTTGGCGTGCTAGAGGTTTACGCGGTCAAGGGGG
ATTAGTACCAGTTGCCATTCAATTGTATCAGGATCCGACCCTACCTAATCAGCGCATCTATACCCCCGATGACG
GACTTAATTGGTTAATGGCGAAAATTTTCGTGCAAATTGCCGACGGAAATCACCATGAATTAGTTAGTCACCTC
ACCCATACCCATTTAGTAGCGGAAGCTTTTGTTTTAGCCACAGCTACCGAGTTAGCACTTAATCATCCTCTGGC
AATTCTATTAAGACCTCATTTTCAATTTACCCTCGCTATTAATACTCTAGCCGAGAGCGAGTTAATTAGCCCTGG
CGGATTCGTTGATCGTCTATTAGCGGGGACGCTAGAAGCATCGATCGAGCTAATTAAGAGTTCCTATCGTCAA
AGATTGGATAATTTCGCCGATTATGCCCTACCAAAGCAATTAGAATTGCGCCAAGTCCAGGATACCTCGCTACT
ACCAGATTACCCCTACCGAGACGATGCTCTCTTACTTTGGCAAGCAACGGAAACCTACGTCAAAGATTACCTAA
GTCTTTACTATACTTCCGATGCGGATGTAAACGGGGATACAGAATTACAAGCCTGGGTGCGAAAATTGATGTC
ACCTGAAGGTGGAGGCATCAAAAAATTAGTTTCTGACGGACAATTAGACACTTTAGCCAAATTAATCGAAGTT
GTCACCCAGATAATTTTTGTGGCTGGACCACAACACGCGGCGGTTAATTATCCTCAATACGATTATCTCGCCTT
TTGCCCGAATATTCCCCTAGCGGGTTATCAATCCCCTCCCAAAGCAGCTGAGGAAGTGGATATAGATTATATTC
TCCGTCTTTTGCCGCCCCAGGCCCAGGCCGCTTATCAATTGGAAATTATGCAGACTTTAACAGCTTTTCAATTTA
ACCGTTTTGGTTATCCATCCCGAAGTGCTTTCCCAGATCAACGCACTTACCCGATTTTGGCGGTTTTCCAAGCTA
AATTAAAAGCGATCGAAAATGAGATCGATCGGCGCAATTTAACCCGATTTACGCCTTATATTTTCCTGAAACCC
TCTCGCATACCCAATAGTATCAATATTTGA

-continued

Amino acid Sequence for WP_045360762.1

SEQ ID NO: 142

MLTPSLPQNDPDPAKRQDLLRRQKQVYIYDSVNGITLVKDLPTHENFSISYQVMRGKGFSALIANGVATRVENIFDP

FDKLEDYEELFPLLPQPTSIKNWQSNTSFAYQRLAGANPMVIRGISSLPDNFPVTDAIFQKAMGPDKTIASEAAKGN

LFLADYATLHHLTLGSYQRGMKTVTAPLVLFCWRARGLRGQGGLVPVAIQLYQDPTLPNQRIYTPDDGLNWLMA

KIFVQIADGNHHELVSHLTHTHLVAEAFVLATATELALNHPLAILLRPHFQFTLAINTLAESELISPGGFVDRLLAGTLE

ASIELIKSSYRQRLDNFADYALPKQLELRQVQDTSLLPDYPYRDDALLLWQATETYVKDYLSLYYTSDADVNGDTELQ

AWVRKLMSPEGGGIKKLVSDGQLDTLAKLIEVVTQIIFVAGPQHAAVNYPQYDYLAFCPNIPLAGYQSPPKAAEEV

DIDYILRLLPPQAQAAYQLEIMQTLTAFQFNRFGYPSRSAFPDQRTYPILAVFQAKLKAIENEIDRRNLTRFTPYIFLKP

SRIPNSINI

Coding sequence for REJ48186.1

SEQ ID NO: 143

ATGCTGACACCATCGCTCCCCAAAAATGATCCTGATCCAGTCAAAAGACAAGAGCTATTAAGACGACAAAAAC

AAGTGTACATTTATGATTCCGTTAATGGTATCACCCTCGTCAAAGATTTACCTACCCACGAAAACTTTTCTATTT

CCTATCAAGTAATGCGGGGTAAAGGTTTCAGTGCTTTAATTGCCAATGGAGTCGCCACAAGGGTAGAAAATAT

CTTCGATCCCTTTGACAAATTAGAAGATTACGAAGAACTTTTTCCCATCCTTCCCCAACCCACAAGCATTAAAAC

TTGGCAATCTAACACAAGTTTTGCCTACCAAAGATTAGCGGGAGCAAATCCCATGGTAATCCGCGGGATTAGC

AGCTTACCAAATAATTTTCCCGTCAGCGATGCTATCTTCCAAAAAGCTATGGGACCCGATAAAACCATTGCCTC

GGAAGCCGCTAAGGGTAACTTATTTCTAGCAGATTATGCCCCCCTACACCACCTAACTTTAGGCAGTTATCAAA

GGGGTATGAAAACTGTGACAGCACCTCTTGTCCTTTTCTGTTGGCGTGCTAGAGGTTTACGGGGTCAAGGGG

GATTAGTACCAGTTGCCATTCAATTGTATCAGGATCCGACCCTACCTAATCAGCGCATCTATACCCCCGATGAC

GGACTTAATTGGTTAATGGCGAAAATTTTCGTGCAAATTGCCGACGGAAATCACCATGAATTAGTTAGTCACC

TCAGCCATACCCATTTAGTAGCGGAAGCTTTTGTTTTAGCCACAGCTACCGAGTTAGCACTTAATCATCCTCTG

GCAATTCTATTAAGACCTCATTTTCAATTTACCCTCGCTATTAATAGTTTAGCCGAGAGCGAGTTAATTAACCCC

GGCGGATTCGTTGATCGTCTATTAGCGGGGACCCTAGAAGCATCTATCGAGCTAATTAAGAGTTCCTATCGTC

AAAGATTGGATAATTTCGCCGATTATGCCCTACCAAAGCAATTAGAATTGCGCCAGGTCCAGGATACCTCCCT

ACTACCAGATTACCCCTACCGAGACGATGCTCTCTTACTTTGGCAAGCAACGGAAACCTACGTCAAAGATTACC

TAAGTCTTTACTATACTTCCGACGCGGACGTAAACGAGGATACAGAATTACAAGCTTGGGCGCGAAAATTGAT

GTCATCTGAAGGTGGAGGCATCAAAAAATTAGTTTCTGACGGAGAATTAGACACTTTAGCCAAATTAGTTGAA

GTTGTCACCCAGATAATTTTTGTGGCCGGACCACAACACGCGGCGGTTAATTATCCTCAATACGATTATCTCGC

CTTTAGCCCCAATATTCCCCTAGCGGGTTATCAATCCCCTCCCAAAGCAGCTGAGGAAGTGGATATAGATTATA

TTCTCCGTCTTTTGCCGCCCCAGGCCCAGGCCGCTTATCAATTGGAAATTATGCAGACTTTAACAGCTTTTCAAT

TTAACCGTTTTGGTTATCCATCCCGAAGTGCTTTCCCAGATCAACGTGCTTACCCGATTTTGGCGGTTTTCCAAG

CTAAATTAAAAGCGATCGAAAATGAGATCGATCGGCGCAATTTAACCCGATTTACGCCTTATATTTTCCTGAAA

CCCTCTCGCATACCCAATAGTATCAATATTTAG

Amino acid Sequence for REJ48186.1

SEQ ID NO: 144

MLTPSLPKNDPDPVKRQELLRRQKQVYIYDSVNGITLVKDLPTHENFSISYQVMRGKGFSALIANGVATRVENIFDP

FDKLEDYEELFPILPQPTSIKTWQSNTSFAYQRLAGANPMVIRGISSLPNNFPVSDAIFQKAMGPDKTIASEAAKGNL

FLADYAPLHHLTLGSYQRGMKTVTAPLVLFCWRARGLRGQGGLVPVAIQLYQDPTLPNQRIYTPDDGLNWLMAKI

FVQIADGNHHELVSHLSHTHLVAEAFVLATATELALNHPLAILLRPHFQFTLAINSLAESELINPGGFVDRLLAGTLEA

SIELIKSSYRQRLDNFADYALPKQLELRQVQDTSLLPDYPYRDDALLLWQATETYVKDYLSLYYTSDADVNEDTELQA

WARKLMSSEGGGIKKLVSDGELDTLAKLVEVVTQIIFVAGPQHAAVNYPQYDYLAFSPNIPLAGYQSPPKAAEEVDI

-continued

DYILRLLPPQAQAAYQLEIMQTLTAFQFNRFGYPSRSAFPDQRAYPILAVFQAKLKAIENEIDRRNLTRFTPYIFLKPSR
IPNSINI

Coding sequence for REJ50596.1

SEQ ID NO: 145

ATGCTGACACCATCGCTACCCCAAAATGATCCTGATCCAGCCAAAAGACAAGATCTATTAAGACGACAAAAAC
AAGTGTACGTCTATGATTCCGTTAATGGTATCACCCTCGTCAAAGATTTACCCACCCACGAAAACTTTTCTATTT
CCTATCAAGTAATGCGGGGTAAAGGTTTCAGTGCTTTAATTGCCAATGGAGTGGCCACAAGAGTAGAAAATAT
CTTCGATCCCTTTGACAAATTAGAAGATTACGAAGAACTTTTTCCCATCCTTCCCAAACCCACAAGTATTAAAAC
TTGGCAATCTAACACAAGTTTTGCCTACCAAAGATTAGCAGGAGCAAATCCCATGGTAATTCGCGGGATTAGC
AGCTTACCAGATAATTTCCCAGTCACCGATGCTATCTTCCAAAAAGCCATGGGACCGGATAAAACCATTGCCTC
GGAAGCCGCTAAGGGTAACTTATTTCTAGCAGATTATGCCCCCCTACACCACCTAACTTTAGGCAGTTATCAAA
AGGGTATGAAAACTGTAACAGCACCTCTTGTCCTTTTCTGTTGGCGTGCTAGAGGTTTACGCGGTCAAGGGGG
ATTAGTACCTGTTGCCATTCAATTATATCAGGATCCTACCCAACCTAATCAGCGCATCTATACCCCCGATGACG
GACTTAATTGGTTAATGGCGAAGATTTTCGTGCAAATTGCCGACGGAAATCATCATGAATTAGTTAGTCACCTC
AGCCATACCCATTTAGTAGCGGAAGCTTTTGTTTTAGCCACAGCTACCGAGTTAGCACTCAATCATCCTCTGGC
AATTCTATTAAGACCTCATTTTCAATTTACCCTCGCCATTAATAGTTTAGCCGAGAGCGAGTTAATTAACCCCGG
CGGATTCGTTGATCGTCTATTAGCGGGGACGCTAGAAGCATCTATCGAGATAATTAAGACTTCCTATCGTCAA
AGATTGGATAATTTCGCCGATTATACCCTACCCAAGCAATTAGCCTTCCGCCAAGTCGATGATACCTCCCTACT
ACCAGATTACCCCTACCGAGACGATGCTCTCTTACTTTGGCAAGCAACGGAAACCTACGTCAAAGATTACCTAA
GTCTTTACTATACTTCCGACGCGGATGTAAACAAGGATACAGAATTACAAGCTTGGGTGCGAAAATTGATGTC
ACCTGAAGGTGGAGGCATTAAAAAATTAGTTTCTGACGGAAAATTAGACACTTTAGCCAAATTAATCGAAGTT
GTCACCCAGATAATTTTTATTGCTGGACCACAACACGCGGCGGTTAATTATTCTCAATACGATTATCTCGCCTTT
TGCGCGAATATTCCCCTAGCCGGTTATCAATCTCCTCCCAAAGCATCTGAGGAGGTGGATATGGATTATATTCT
CCGTCTTTTGCCCCCCCAGGCCCAGGCCACTTATCAATTGGAAATTATGCACACTTTAACAGCTTTTCAATTCAA
CCGTTTTGGTTATCCATCCCGAAATGATTTCCCAGATCAACGCACTTACCCGATTTTGGCGGTTTTCCAAGCTAA
ATTAAAAGCGATCGAAAATGAGATCGATCGGCGCAATTCAACCCGAATTACGCCTTATATTTTCCTGAAACCCT
CTCGCATCCCCAATAGTATCAATATTTAA

Amino acid Sequence for REJ50596.1

SEQ ID NO: 146

MLTPSLPQNDPDPAKRQDLLRRQKQVYVYDSVNGITLVKDLPTHENFSISYQVMRGKGFSALIANGVATRVENIFD
PFDKLEDYEELFPILPKPTSIKTWQSNTSFAYQRLAGANPMVIRGISSLPDNFPVTDAIFQKAMGPDKTIASEAAKGN
LFLADYAPLHHLTLGSYQKGMKTVTAPLVLFCWRARGLRGQGGLVPVAIQLYQDPTQPNQRIYTPDDGLNWLMA
KIFVQIADGNHHELVSHLSHTHLVAEAFVLATATELALNHPLAILLRPHFQFTLAINSLAESELINPGGFVDRLLAGTLE
ASIEIIKTSYRQRLDNFADYTLPKQLAFRQVDDTSLLPDYPYRDDALLLWQATETYVKDYLSLYYTSDADVNKDTELQ
AWVRKLMSPEGGGIKKLVSDGKLDTLAKLIEVVTQIIFIAGPQHAAVNYSQYDYLAFCANIPLAGYQSPPKASEEVD
MDYILRLLPPQAQATYQLEIMHTLTAFQFNRFGYPSRNDFPDQRTYPILAVFQAKLKAIENEIDRRNSTRITPYIFLKP
SRIPNSINI

Coding sequence for WP_041804209.1

SEQ ID NO: 147

ATGCTGACACCATCGCTACCCAAAAATGATCCTGATCCAGTCAAAAGACAAGATCTATTAAGACGACAAAAAC
AAGTGTACATTTATGATTCCGTTAATGGTATCACCCTCGTCAAAGATTTACCTACCCACGAAAACTTTTCTATTT
CCTATCAAGTAATGCGGGGTAAAGGTTTCAGTGCTTTAATTGCCAATGGAGTCGCCACAAGGGTAGAAAATAT
CTTCGATCCCTTTGACAAATTAGAAGATTACGAAGAACTTTTTCCCATCCTTCCCCAACCCACAAGCATTAAAAC
TTGGCAATCTAACACAAGTTTTGCCTACCAAAGATTAGCGGGAGCAAATCCCATGGTAATCCGCGGGATTAGC

-continued

AGCTTACCAAATAATTTTCCCGTCAGCGATGCTATCTTCCAAAAAGCTATGGACCCGATAAAACCATTGCCTC
GGAAGCCGCTAAGGGTAACTTATTTCTAGCAGATTATGCCCCCCTACACCACCTAACTTTAGGCAGTTATCAAA
GGGGTATGAAAACTGTGACAGCACCTCTTGTCCTTTTCTGTTGGCGTGCTAGAGGTTTACGGGGTCAAGGGG
GATTAGTACCAGTTGCCATTCAATTGTATCAGGATCCGACCCTACCTAATCAGCGCATCTATACCCCCGATGAC
GGACTTAATTGGTTAATGGCGAAAATTTTCGTGCAAATTGCCGACGGAAATCACCATGAATTAGTTAGTCACC
TCAGCCATACCCATTTAGTAGCGGAAGCTTTTGTTTTAGCCACAGCTACCGAGTTAGCACTTAATCATCCTCTG
GCAATTCTATTAAGACCTCATTTTCAATTTACCCTCGCTATTAATAGTTTAGCCGAGAGCGAGTTAATTAACCCC
GGCGGATTCGTTGATCGTCTATTAGCGGGGACCCTAGAAGCATCTATCGAGCTAATTAAGAGTTCCTATCGTC
AAAGATTGGATAATTTCGCCGATTATGCCCTACCAAAGCAATTAGAATTGCGCCAGGTCCAGGATACCTCCCT
ACTACCAGATTACCCCTACCGAGACGATGCTCTCTTACTTTGGCAAGCAACGGAAACCTACGTCAAAGATTACC
TAAGTCTTTACTATACTTCCGACGCGGACGTAAACGAGGATACAGAATTACAAGCTTGGGCGCGAAAATTGAT
GTCATCTGAAGGTGGAGGCATCAAAAAATTAGTTTCTGACGGAGAATTAGACACTTTAGCCAAATTAGTCGAA
GTTGTCACCCAGATAATTTTTGTGGCCGGACCACAACACGCGGCGGTTAATTATCCTCAATACGATTATCTCGC
CTTTAGCCCCAATATTCCCCTAGCGGGTTATCAATCCCCTCCCAAAGCAGCTGAGGAAGTGGATATAGATTATA
TTCTCCGTCTTTTGCCGCCCCAGGCCCAGGCCGCTTATCAATTGGAAATTATGCAGACTTTAACAGCTTTTCAAT
TTAACCGTTTTGGTTATCCATCCCGAAGTGCTTTCCCAGATCAACGTGCTTACCCGATTTTGGCGGTTTTCCAAG
CTAAATTAAAAGCGATCGAAAATGAGATCGATCGGCGCAATTTAACCCGATTTACGCCTTATATTTTCCTGAAA
CCCTCTCGCATACCCAATAGTATCAATATTTAG

Amino acid Sequence for WP_041804209.1

SEQ ID NO: 148

MLTPSLPKNDPDPVKRQDLLRRQKQVYIYDSVNGITLVKDLPTHENFSISYQVMRGKGFSALIANGVATRVENIFDP
FDKLEDYEELFPILPQPTSIKTWQSNTSFAYQRLAGANPMVIRGISSLPNNFPVSDAIFQKAMGPDKTIASEAAKGNL
FLADYAPLHHLTLGSYQRGMKTVTAPLVLFCWRARGLRGQGGLVPVAIQLYQDPTLPNQRIYTPDDGLNWLMAK1
FVQIADGNHHELVSHLSHTHLVAEAFVLATATELALNHPLAILLRPHFQFTLAINSLAESELINPGGFVDRLLAGTLEA
SIELIKSSYRQRLDNFADYALPKQLELRQVQDTSLLPDYPYRDDALLLWQATETYVKDYLSLYYTSDADVNEDTELQA
WARKLMSSEGGGIKKLVSDGELDTLAKLVEVVTQIIFVAGPQHAAVNYPQYDYLAFSPNIPLAGYQSPPKAAEEVDI
DYILRLLPPQAQAAYQLEIMQTLTAFQFNRFGYPSRSAFPDQRAYPILAVFQAKLKAIENEIDRRNLTRFTPYIFLKPSR
IPNSINI

Coding sequence for WP_004162848.1

SEQ ID NO: 149

ATGCTGACACCATCGCTCCCCAAAAATGATCCTGATCCAGTCAAAAGACAAGATCTATTAAGACGACAAAAAC
AAGTGTACATTTATGATTCCGTTAATGGTATCACCCTCGTCAAAGATTTACCTCCCCACGAAAACTTTTCTATTT
CCTATCAAGTAATGCGGGGTAAAGGTTTCAGTGCTTTAATTGCCAATGGAGTCGCCACAAGGGTAGAAAATAT
CTTCGATCCCTTTGACAAATTAGAAGATTACGAAGAACTTTTTCCCATCCTTCCCCAACCCACAAGCATTAAAAC
TTGGCAATCTAACACAAGTTTTGCCTACCAAAGATTAGCGGGAGCAAATCCCATGGTAATCCGCGGGATTAGC
AGCTTACCAAATAATTTTCCCGTCAGCGATGCTATCTTCCAAAAAGCTATGGACCCGATAAAACCATTGCCTC
GGAAGCCGCTAAGGGTAACTTATTTCTAGCAGATTATGCCCCCCTACACCACCTAACTTTAGGCAGTTATCAAA
GGGGTATGAAAACTGTGACAGCACCTCTTGTCCTTTTCTGTTGGCGTGCTAGAGGTTTACGGGGTCAAGGGG
GATTAGTACCAGTTGCCATTCAATTGTATCAGGATCCGACCCTACCTAATCAGCGCATCTATACCCCCGATGAC
GGACTTAATTGGTTAATGGCGAAAATTTTCGTGCAAATTGCCGACGGAAATCACCATGAATTAGTTAGTCACC
TCAGCCATACCCATTTAGTAGCGGAAGCTTTTGTTTTAGCCACAGCTACCGAGTTAGCACTTAATCATCCTCTG
GCAATTCTATTAAGACCTCATTTTCAATTTACCCTCGCTATTAATAGTTTAGCCGAGAGCGAGTTAATTAACCCC

-continued

GGCGGATTCGTTGATCGTCTATTAGCGGGGACCCTAGAAGCATCTATCGAGCTAATTAAGAGTTCCTATCGTC

AAAGATTGGATAATTTCGCCGATTATGCCCTACCAAAGCAATTAGAATTGCGCCAGGTCCAGGATACCTCCCT

ACTACCAGATTACCCCTACCGAGACGATGCTCTCTTACTTTGGCAAGCAACGGAAACCTACGTCAAAGATTACC

TAAGTCTTTACTATACTTCCGACGCGGACGTAAACGAGGATACAGAATTACAAGCTTGGGCGCGAAAATTGAT

GTCATCTGAAGGTGGAGGCATCAAAAAATTAGTTTCTGACGGAGAATTAGACACTTTAGCCAAATTAGTCGAA

GTTGTCACCCAGATAATTTTTGTGGCCGGACCACAACACGCGGCGGTTAATTATCCTCAATACGATTATCTCGC

CTTTAGCCCCAATATTCCCCTAGCGGGTTATCAATCCCCTCCCAAAGCAGCTGAGGAAGTGGATATAGATTATA

TTCTCCGTCTTTTGCCGCCCCAGGCCCAGGCCGCTTATCAATTGGAAATTATGCAGACTTTAACAGCTTTTCAAT

TTAACCGTTTTGGTTATCCATCCCGAAGTGCTTTCCCAGATCAACGTGCTTACCCGATTTTGGCGGTTTTCCAAG

CTAAATTAAAAGCGATCGAAAATGAGATCGATCGGCGCAATTTAACCCGATTTACGCCTTATATTTTCCTGAAA

CCCTCTCGCATACCCAATAGTATCAATATTTAG

Amino acid Sequence for WP_004162848.1

SEQ ID NO: 150

MLTPSLPKNDPDPVKRQDLLRRQKQVYIYDSVNGITLVKDLPPHENFSISYQVMRGKGFSALIANGVATRVENIFDP

FDKLEDYEELFPILPQPTSIKTWQSNTSFAYQRLAGANPMVIRGISSLPNNFPVSDAIFQKAMGPDKTIASEAAKGNL

FLADYAPLHHLTLGSYQRGMKTVTAPLVLFCWRARGLRGQGGLVPVAIQLYQDPTLPNQRIYTPDDGLNWLMAK1

FVQIADGNHHELVSHLSHTHLVAEAFVLATATELALNHPLAILLRPHFQFTLAINSLAESELINPGGFVDRLLAGTLEA

SIELIKSSYRQRLDNFADYALPKQLELRQVQDTSLLPDYPYRDDALLLWQATETYVKDYLSLYYTSDADVNEDTELQA

WARKLMSSEGGGIKKLVSDGELDTLAKLVEVVTQIIFVAGPQHAAVNYPQYDYLAFSPNIPLAGYQSPPKAAEEVDI

DYILRLLPPQAQAAYQLEIMQTLTAFQFNRFGYPSRSAFPDQRAYPILAVFQAKLKAIENEIDRRNLTRFTPYIFLKPSR

IPNSINI

Coding sequence for BAG04096.1

SEQ ID NO: 151

ATGTACATTTATGATTCCGTTAATGGTATCACCCTCGTCAAAGATTTACCTACCCACGAAAACTTTTCTATTTCCT

ATCAAGTAATGCGGGGTAAAGGTTTCAGTGCTTTAATTGCCAATGGAGTCGCCACAAGGGTAGAAAATATCTT

CGATCCCTTTGACAAATTAGAAGATTACGAAGAACTTTTTCCCATCCTTCCCCAACCCACAAGCATTAAAACTTG

GCAATCTAACACAAGTTTTGCCTACCAAAGATTAGCGGGAGCAAATCCCATGGTAATCCGCGGGATTAGCAGC

TTACCAAATAATTTTCCCGTCAGCGATGCTATCTTCCAAAAAGCTATGGGACCCGATAAAACCATTGCCTCGGA

AGCCGCTAAGGGTAACTTATTTCTAGCAGATTATGCCCCCCTACACCACCTAACTTTAGGCAGTTATCAAAGGG

GTATGAAAACTGTGACAGCACCTCTTGTCCTTTTCTGTTGGCGTGCTAGAGGTTTACGGGGTCAAGGGGGATT

AGTACCAGTTGCCATTCAATTGTATCAGGATCCGACCCTACCTAATCAGCGCATCTATACCCCCGATGACGGAC

TTAATTGGTTAATGGCGAAAATTTTCGTGCAAATTGCCGACGGAAATCACCATGAATTAGTTAGTCACCTCAGC

CATACCCATTTAGTAGCGGAAGCTTTTGTTTTAGCCACAGCTACCGAGTTAGCACTTAATCATCCTCTGGCAATT

CTATTAAGACCTCATTTTCAATTTACCCTCGCTATTAATAGTTTAGCCGAGAGCGAGTTAATTAACCCCGGCGG

ATTCGTTGATCGTCTATTAGCGGGGACCCTAGAAGCATCTATCGAGCTAATTAAGAGTTCCTATCGTCAAAGAT

TGGATAATTTCGCCGATTATGCCCTACCAAAGCAATTAGAATTGCGCCAGGTCCAGGATACCTCCCTACTACCA

GATTACCCCTACCGAGACGATGCTCTCTTACTTTGGCAAGCAACGGAAACCTACGTCAAAGATTACCTAAGTCT

TTACTATACTTCCGACGCGGACGTAAACGAGGATACAGAATTACAAGCTTGGGCGCGAAAATTGATGTCATCT

GAAGGTGGAGGCATCAAAAAATTAGTTTCTGACGGAGAATTAGACACTTTAGCCAAATTAGTCGAAGTTGTCA

CCCAGATAATTTTTGTGGCCGGACCACAACACGCGGCGGTTAATTATCCTCAATACGATTATCTCGCCTTTAGC

CCCAATATTCCCCTAGCGGGTTATCAATCCCCTCCCAAAGCAGCTGAGGAAGTGGATATAGATTATATTCTCCG

TCTTTTGCCGCCCCAGGCCCAGGCCGCTTATCAATTGGAAATTATGCAGACTTTAACAGCTTTTCAATTTAACCG

TTTTGGTTATCCATCCCGAAGTGCTTTCCCAGATCAACGTGCTTACCCGATTTTGGCGGTTTTCCAAGCTAAATT

-continued

AAAAGCGATCGAAAATGAGATCGATCGGCGCAATTTAACCCGATTTACGCCTTATATTTTCCTGAAACCCTCTC

GCATACCCAATAGTATCAATATTTAG

Amino acid Sequence for BAG04096.1

SEQ ID NO: 152

MYIYDSVNGITLVKDLPTHENFSISYQVMRGKGFSALIANGVATRVENIFDPFDKLEDYEELFPILPQPTSIKTWQSN

TSFAYQRLAGANPMVIRGISSLPNNFPVSDAIFQKAMGPDKTIASEAAKGNLFLADYAPLHHLTLGSYQRGMKTVT

APLVLFCWRARGLRGQGGLVPVAIQLYQDPTLPNQRIYTPDDGLNWLMAKIFVQIADGNHHELVSHLSHTHLVAE

AFVLATATELALNHPLAILLRPHFQFTLAINSLAESELINPGGFVDRLLAGTLEASIELIKSSYRQRLDNFADYALPKQLE

LRQVQDTSLLPDYPYRDDALLLWQATETYVKDYLSLYYTSDADVNEDTELQAWARKLMSSEGGGIKKLVSDGELDT

LAKLVEVVTQIIFVAGPQHAAVNYPQYDYLAFSPNIPLAGYQSPPKAAEEVDIDYILRLLPPQAQAAYQLEIMQTLTA

FQFNRFGYPSRSAFPDQRAYPILAVFQAKLKAIENEIDRRNLTRFTPYIFLKPSRIPNSINI

Coding sequence for WP_002786802.1

SEQ ID NO: 153

ATGCTGACACCATCGCTACCCCAAAATGATCCTGATCCAGCCAAAAGACAAGAGCTATTAAGACGACAAAAAC

AAGTGTACATCTATGATTCCGTTAATGGTATCACCCTCGTCAAAGATTTACCTACCCACGAAAACTTTTCTATTT

CCTATCAAGTAATGCGGGGTAAAGGTTTCAGTGCTTTAATTGCCAATGGCGTGGCCACGAGAATAGAAAACG

TCTTTGATCCCTTCGACAAATTAGAAGATTACGAAGAACTTTTTCCCATCCTTCCCCAACCCACAAGCATTAAAA

CTTGGCAATCTAACACAAGTTTTGCCTACCAAAGATTAGCGGGAGCAAATCCCATGGTCATCCGCGGGATTAG

CAGCTTACCGGATAATTTTCCCGTCAGCGATGCTATCTTCCAAAAAGCCATGGGACCTGATAAAACCATTGCCT

CGGAAGCCGCTAAGGGTAACTTATTTCTAGCAGATTATGCCCCCCTAAACAACCTAACTTTAGGCAGTTATCAA

CGGGGGATGAAAACTGTAACAGCACCTCTTGTCCTTTTCTGTTGGCGTGCTAGAGGTTTACGGGGTCAAGGG

GGATTAGTACCAGTTGCCATTCAATTGTATCAGGAGCCGACCCTACCTAATCAGCGCATCTATACCCCCGACGA

CGGACTTAATTGGTTAATGGCGAAGATTTTCGTGCAAATTGCCGATGGAAACCACCATGAATTAGTTAGTCAC

CTCAGCCATACCCATTTAGTAGCGGAAGCTTTTGTTTTAGCCACAGCTACCGAGTTAGCACTTAATCATCCTCTG

GCAATTCTATTAAGACCTCATTTTCAATTTACCCTCGCTATTAATAGTTTAGCCGAGAGCGAGTTAATTAACCCC

GGCGGATTCGTTGATCGTCTATTAGCGGGGACGCTAGAAGCATCGATCGAGCTAATTAAGAGTTCCTATCGTC

AAAGATTAGATAATTTCGCCGATTATGCCCTACCAAAGCAATTAGAATTGCGCCAAGTCCAGGATACCTCGCT

ACTACCAGATTACCCCTACCGAGACGATGCTCTCTTACTTTGGCAAGCAACGGAAACCTACGTCAAAGATTACC

TAAGTCTTTACTATACTTCCGATGCGGACGTAAATGAGGATACAGAATTACAAGCTTGGGTGCGAACATTGAT

GTCACCTGAAGGTGGAGGCATCAAAAAATTAGTTTCTGAAGGAGAATTAGACACTTTGGCCAAATTAATCGAA

GTTGTCACCCAGATAATTTTTGTGGCCGGACCACAACACGCGGCGGTTAATTATCCTCAATACGATTATCTCGC

CTTTTGCCCGAATATTCCCCTAGCGGGTTATCAATCTCCTCCCAAAGCAGCTGAGCAGGTGGATATAGATTATA

TTCTCCGTCTTTTGCCCCCCCAGGCCCAGGCCGCTTATCAATTGGAAATTATGCAGACTTTAACAGCTTTTCAAT

TTAACCGTTTTGGCTATCCATCCCGAAGTGCTTTCCCAGATCAACGCACTTACCCGATTTTGGCGGTTTTCCAAG

CTAAATTAAAGGCGATCGAAAATCAGATCGATCGGCGCAATTTAACCCGATTTACGCCTTATATTTTCCTGAAA

CCCTCTCGCATCCCCAATAGTATCAATATTTAG

Amino acid Sequence for WP_002786802.1

SEQ ID NO: 154

MLTPSLPQNDPDPAKRQELLRRQKQVYIYDSVNGITLVKDLPTHENFSISYQVMRGKGFSALIANGVATRIENVFDP

FDKLEDYEELFPILPQPTSIKTWQSNTSFAYQRLAGANPMVIRGISSLPDNFPVSDAIFQKAMGPDKTIASEAAKGNL

FLADYAPLNNLTLGSYQRGMKTVTAPLVLFCWRARGLRGQGGLVPVAIQLYQEPTLPNQRIYTPDDGLNWLMAKI

FVQIADGNHHELVSHLSHTHLVAEAFVLATATELALNHPLAILLRPHFQFTLAINSLAESELINPGGFVDRLLAGTLEA

SIELIKSSYRQRLDNFADYALPKQLELRQVQDTSLLPDYPYRDDALLLWQATETYVKDYLSLYYTSDADVNEDTELQA

-continued

WVRTLMSPEGGGIKKLVSEGELDTLAKLIEVVTQIIFVAGPQHAAVNYPQYDYLAFCPNIPLAGYQSPPKAAEQVDI

DYILRLLPPQAQAAYQLEIMQTLTAFQFNRFGYPSRSAFPDQRTYPILAVFQAKLKAIENQIDRRNLTRFTPYIFLKPS

RIPNSINI

Coding sequence for WP_002800102.1

SEQ ID NO: 155

ATGATACCATCGCTACCCCAAAATGATGCTGATTCTATCAAACGACAAGAATTACTACAAAGACAAAAACAAG

TCTACATCTATGATTCCGTTAGTGGTATCACCCTCGTCAAAGATTTACCTGCCCAAGAAAATTTCTCTATTTCCT

ATCAATTAATGCTGCGTAAAGGCTTGAGTGCTTTAATTGCCAATAGCGTGGCCACGAAAATAGAAAATGTCTT

TGATCCCTTTGACAAATTAGAAGATTACGAACAACTTTTTCCTCTCCTTCCCAAACCCACAAGTATTAAAACTTG

GCAATCTAACACAAGTTTTGCCTACCAAAGATTAGCGGGATTAAATCCCATGGTCATCCGCGGGATTAGCAGC

ATACCGGATAATTTCCCCGTCAGCGATGCTATCTTCCAAAAAGCCATGGGACCCGATAAAACCATTGCCTCGG

AAGCCGCTAAGGGTAACTTATTTCTAGCAGATTATGCCCCCCTAAACAACCTAACTTTAGGCAGTTATCAAAGG

GGTATGAAAACCGCAACAGCACCTCTTGTCCTTTTCTGTTGGCGTGCTAGGGGTTTACGGGGTCAAGGGGGAT

TAGTACCGGTTGCCATTCAATTGTATCAGGATCCGACCGTACCTAATCAGCGCATCTATACCCCCGATGACGGA

CTTAATTGGTTAATGGCGAAGATTTTCGTGCAAATTGCCGACGGAAATCACCATGAATTAGTTAGTCATCTCAG

CCATACCCATTTAGTAGCGGAAGCTTTTGTTTTAGCCACAGCTACCGAGTTAGCACTCAATCATCCTCTGGCAA

TTCTATTAAAACCTCATTTTCAATTTACCCTCGCTATTAATACTTTAGCCGAGAGCGAGTTAATTAGCCCAGGCG

GATTCGTTGATCGTCTATTAGCGGGGACGCTAGAAGCATCTATCGAGATAATTAAGACTTCCTATCGTCAAAG

ATTGGATAATTTCGCCGATTATACCCTACCCAAGCAATTAGCCTTCCGCCAAGTCGATGATACCTCCCGACTAC

CAGATTACCCCTACCGGGACGATGCTCTCTTACTTTGGCAAGCAACGGAAACCTACGTCAAAGATTACCTAAG

TCTTTACTATACTTCCGACGCGGATGTAAACGAGGATACAGAATTACAAGCTTGGGTGCGAAAATTGATGTCA

CCTGAAGGTGGAGGCATTAAAAAATTAGTTTCTGACGGAAAATTAGACACTTTAGCCAAATTAATCGAAGTTG

TCACCCAGATAATTTTTATTGCTGGACCACAACACGCGGCGGTTAATTATTCTCAATACGATTATCTCGCCTTTT

GCGCGAATATTCCCCTAGCCGGTTATCAATCTCCTCCCAAAGCATCTGAGGAGGTGGATATGGATTATATTCTC

CGTCTTTTGCCCCCCCAGGCCCAGGCCACTTATCAATTGGAAATTATGCACACTTTAACAGCTTTTCAATTCAAC

CGTTTTGGTTATCCATCCCGAAATGATTTCCCAGATCAACGCACTTACCCGATTTTGGCGGTTTTCCAAGCTAAA

TTAAAAGCGATCGAAAATGAGATCGATCGGCGCAATTCAACCCGAATTACGCCTTATATTTTCCTGAAACCCTC

TCGCATCCCCAATAGTATCAATATTTAG

Amino acid Sequence for WP_002800102.1

SEQ ID NO: 156

MIPSLPQNDADSIKRQELLQRQKQVYIYDSVSGITLVKDLPAQENFSISYQLMLRKGLSALIANSVATKIENVFDPFDK

LEDYEQLFPLLPKPTSIKTWQSNTSFAYQRLAGLNPMVIRGISSIPDNFPVSDAIFQKAMGPDKTIASEAAKGNLFLA

DYAPLNNLTLGSYQRGMKTATAPLVLFCWRARGLRGQGGLVPVAIQLYQDPTVPNQRIYTPDDGLNWLMAKIFV

QIADGNHHELVSHLSHTHLVAEAFVLATATELALNHPLAILLKPHFQFTLAINTLAESELISPGGFVDRLLAGTLEASIEI

IKTSYRQRLDNFADYTLPKQLAFRQVDDTSRLPDYPYRDDALLLWQATETYVKDYLSLYYTSDADVNEDTELQAWV

RKLMSPEGGGIKKLVSDGKLDTLAKLIEVVTQIIFIAGPQHAAVNYSQYDYLAFCANIPLAGYQSPPKASEEVDMDYI

LRLLPPQAQATYQLEIMHTLTAFQFNRFGYPSRNDFPDQRTYPILAVFQAKLKAIENEIDRRNSTRITPYIFLKPSRIPN

SINI

Coding sequence for WP_002793167.1

SEQ ID NO: 157

ATGATACCATCGCTACCCCAAAATGATGCTGATTCTATCAAACGACAAGAATTACTACAAAGACAAAAACAAG

TGTACATCTATGATTATGTTAGTGGTATCACCCTCGTCAAAGATTTACCTGCCCAAGAAAATTTCTCTATTTCCT

ATCAATTAATGCTGCGTAAAGGCTTGAGTGCTTTAATTGCCAATGGCGTGGCCACGAGAATAGAAAATGTCTT

TGATCCCTTTGACAAATTAGAAGATTACGAACAACTTTTTCCTATCCTTCCCAAACCCACAAGTATTAAAACTTG

-continued

GCAATCTAACACAGGTTTTGCCTACCAAAGATTAGCGGGAACAAATCCAATGGTCATCCGCGGGATTAGCAGC

TTACCAGATAATTTCCCCGTCAGCGATGCTATCTTCCAAAAAGCGATGGGACCGGATAAAACCATTGCCTCGG

AAGCCGCTAAGGGTAACTTATTTCTAGCAGATTATGCCCCCCTAAACAACCTAACTTTAGGCAGTTATCAACGG

GGGATGAAAACTGTGACAGCACCTCTTGTCCTTTTCTGTTGGCGTGCTAGAGGTTTACGCGGTCAAGGGGGAT

TAGTACCAGTTGCCATTCAATTATATCAAGATCCGACCCTACCTAATCAGCGCATCTATACCCCCGACGACGGA

CTTAATTGGTTAATGGCGAAGATTTTCGTGCAAATTGCCGACGGAAATCATCATGAATTAGTTAGTCACCTCAG

CCATACCCATTTAGTAGCGGAAGCTTTTGTTTTAGCCACAGCTACCGAGTTAGCACTCAATCATCCTCTGGCAA

TTCTATTAAAACCTCATTTTCAATTTACCCTCGCTATTAATACTTTAGCCGAGAACGAGTTAATTAGCCCAGGCG

GATTCGTTGATCGTCTATTAGCGGGGACGCTAGAAGCATCTATCGAGATAATTAAGACTTCCTATCGTCAAAG

ATTGGATAATTTCGCCGATTATACCCTACCCAAGCAATTAGCCTTCCGCCAAGTCGATGACACCTCCCTACTACC

AGATTACCCCTACCGAGACGATGCTCTCTTACTTTGGGAAGCAACGGAAACCTACGTCAAAGATTACCTAAGT

CTTTACTATACTTCCGACGCGGATGTAAACGAGGATACAGAATTACAAGCTTGGGTGCGAAAATTGATGTCAC

CTGAAGGTGGAGGCATTAAAAAATTAGTTTCTGACGGAAAATTAGACACTTTAGCCAAATTAATCGAAGTTGT

CACCCAGATAATTTTTATTGCTGGACCACAACACGCGGCGGTTAATTATTCTCAATACGATTATCTCGCCTTTTG

CGCGAATATTCCCCTAGCCGGTTATCAATCTCCTCCTAAAGCAGCTGAGGAGGTGGATATGGATTATATTCTCC

GTCTTTTGCCCCCCCAGGCCCAGGCCACTTATCAATTGGAAATTATGCACACTTTAACAGCTTTTCAATTCAACC

GTTTTGGTTATCCATCCCGAAATGATTTCCCAGATCAACGCACTTACCCGATTTTGGCGGTTTTCCAAGCTAAAT

TAAAAGCGATCGAAAATGAGATCGATCGGCGCAATTCAACCCGAATTACGCCTTATATTTTCCTGAAACCCTCT

CGCATCCCCAATAGTATTAATATTTAA

Amino acid Sequence for WP_002793167.1

SEQ ID NO: 158

MIPSLPQNDADSIKRQELLQRQKQVYIYDYVSGITLVKDLPAQENFSISYQLMLRKGLSALIANGVATRIENVFDPFD

KLEDYEQLFPILPKPTSIKTWQSNTGFAYQRLAGTNPMVIRGISSLPDNFPVSDAIFQKAMGPDKTIASEAAKGNLFL

ADYAPLNNLTLGSYQRGMKIVTAPLVLFCWRARGLRGQGGLVPVAIQLYQDPTLPNQRIYTPDDGLNWLMAKIF

VQIADGNHHELVSHLSHTHLVAEAFVLATATELALNHPLAILLKPHFQFTLAINTLAENELISPGGFVDRLLAGTLEASI

EIIKTSYRQRLDNFADYTLPKQLAFRQVDDTSLLPDYPYRDDALLLWEATETYVKDYLSLYYTSDADVNEDTELQAW

VRKLMSPEGGGIKKLVSDGKLDTLAKLIEVVTQIIFIAGPQHAAVNYSQYDYLAFCANIPLAGYQSPPKAAEEVDMD

YILRLLPPQAQATYQLEIMHTLTAFQFNRFGYPSRNDFPDQRTYPILAVFQAKLKAIENEIDRRNSTRITPYIFLKPSRIP

NSINI

Coding sequence for WP_061431977.1

SEQ ID NO: 159

ATGATGATACCATCGCTCCCAAAAAATGATCCTGATCCAGTCAAAAGACAAGATCTATTAAGACGACAAAAAC

AAGTGTACATTTATGATTCCGTTAATGGTATCACCCTCGTCAAAGATTTACCTACCCACGAAAACTTTTCTATTT

CCTATCAAGTAATGCGGGGTAAAGGTTTCAGTGCTTTAATTGCCAATGGAGTCGCCACAAGGGTAGAAAATAT

CTTCGATCCCTTTGACAAATTAGAAGATTACGAACAACTTTTTCCTATCCTTCCCCAACCCACAAGCATTAAAAC

TTGGCAATCTAACACAAGTTTTGCCTACCAAAGATTAGCGGGAGCAAATCCCATGGTAATCCGCGGGATTAGC

AGCTTACCAAATAATTTTCCCGTCAGCGATGCCATCTTCCAAAAAGCCATGGGACCCGATAAAACCATTGCCTC

GGAAGCCGCTAAGGGTAACTTATTTCTAGCAGATTATGCCCCCCTACACCACCTAACTTTAGGCAGTTATCAAA

GGGGGATGAAAACTGTGACAGCACCTCTTGTCCTTTTCTGTTGGCGTGCTAGAGGTTTACGGGGTCAAGGGG

GATTAGTACCAGTTGCCATTCAATTGTATCAGGATCCGACCCTACCTAATCAGCGCATCTATACCCCCGATGAC

GGACTTAATTGGTTAATGGCGAAAATTTTCGTGCAAATTGCTGACGGAAATCACCATGAATTAGTTAGTCACCT

CACCCATACCCATTTAGTAGCGGAAGCTTTTGTTTTAGCCACAGCTACCGAGTTAGCACTTAATCATCCTCTGG

-continued

CAATTCTATTAAGACCTCATTTTCAATTTACCCTCGCTATTAATAGTTTAGCCGAGAGCGAGTTAATTAACCCCG

GCGGATTCGTTGATCGTCTATTAGCGGGGACGCTAGAAGCATCTATCGAGCTAATTAAGAGTTCCTATCGTCA

AAGATTGGATAATTTCGCCGATTATACCCTACCAAAGGAATTAGAATTGCGCCAAGTCCAGGATACCTCGCTA

CTACCAGATTACCCCTACCGAGACGATGCTCTCTTACTTTGGCAAGCAACGGAAACCTACGTCAAAGATTACCT

AAGTCTTTACTATACTTCCGACGCGGACGTAAACGAGGATACAGAATTACAAGCTTGGGTGCGAACATTGATG

TCACCTGAAGGTGGAGGCATCAAAAAATTAGTTTCTGACGGAGAATTAGACACTTTAGCCAAATTAGTCGAAG

TTGTCACCCAGATAATTTTTGTGGCCGGACCACAACACGCGGCGGTTAATTATCCTCAATACGATTATCTCGCC

TTTAGCCCCAATATTCCCCTAGCGGGTTATCAATCCCCTCCCAAAGCAGCTGAGGAAGTGGATATAGATTATAT

TCTCCGTCTTTTGCCGCCCCAGGCCCAGGCCGCTTATCAATTGGAAATTATGCAGACTTTAACAGCTTTTCAATT

TAACCGTTTTGGTTATCCATCCCGAAGTGCTTTCCCAGATCAACGTGCTTACCCGATTTTGGCAGTTTTCCAAGC

TAAATTAAAAGCGATCGAAAATGAGATCGATCGGCGCAATTTAACCCGATTTACGCCTTATATTTTCCTGAAAC

CCTCTCGCATACCCAATAGTATCAATATTTGA

Amino acid Sequence for WP_061431977.1

SEQ ID NO: 160

MMIPSLPKNDPDPVKRQDLLRRQKQVYIYDSVNGITLVKDLPTHENFSISYQVMRGKGFSALIANGVATRVENIFD

PFDKLEDYEQLFPILPQPTSIKTWQSNTSFAYQRLAGANPMVIRGISSLPNNFPVSDAIFQKAMGPDKTIASEAAKG

NLFLADYAPLHHLTLGSYQRGMKTVTAPLVLFCWRARGLRGQGGLVPVAIQLYQDPTLPNQRIYTPDDGLNWLM

AKIFVQIADGNHHELVSHLTHTHLVAEAFVLATATELALNHPLAILLRPHFQFTLAINSLAESELINPGGFVDRLLAGTL

EASIELIKSSYRQRLDNFADYTLPKELELRQVQDTSLLPDYPYRDDALLLWQATETYVKDYLSLYYTSDADVNEDTELQ

AWVRTLMSPEGGGIKKLVSDGELDTLAKLVEVVTQIIFVAGPQHAAVNYPQYDYLAFSPNIPLAGYQSPPKAAEEV

DIDYILRLLPPQAQAAYQLEIMQTLTAFQFNRFGYPSRSAFPDQRAYPILAVFQAKLKAIENEIDRRNLTRFTPYIFLKP

SRIPNSINI

Coding sequence for OUS02327.1

SEQ ID NO: 161

ATGGTCGGTCACGATGGGCCGAAATACGCACACGAATCAAATCAACCTTCATTGCCACAAAACGATACCCCAG

CAGAGCAAGAGGCTCGCCGTACTGCATTGGGATTAACTCAAGAAAAATACCATTTGAGCAACGACAATGACCT

GGGCTTACCGCTACTGAAGGAAGTCCCAGCAGAGGAAGCCTTCAGCAATATTTACGAAGCCGGTCGCGCAAT

TGACACTTTTCCCTTGTTAGAGAACCATGACAAGGTAATGTCGCAGCTAACAAATCCCTATGGTCCCTTCACAG

GATTGGCTGATTACGAAAGTATGTTTATTGATATCCCAAAGCCGGCTGTTACCAAAAATTGGTTAACAGACGA

AAGTTTTGGTGAGCAGCGCCTTTCTGGTGTTAATCCCGTAATGATAGAGCGCGTGAAAAATGCAAAAGATTTG

GCCTCCAAGTTTAATGTCAGCCAATTGAAAGATGTCTTGGATAGCGACATAAACTTGGATGAACTCATAAAAG

ATGAGCTATTGTACATTACGGACCTATCCCCCTATCTAAAGGATATTCCTGAAGGTAAAGTACCCTCCCCGGGC

GGCTACATTCCAAAATATTTACCAAAACCCATCGGTTTATTTTACTGGCATAAAGATGGTGCAAAATTAAAGGA

CCCCTCTTTAAAATCGGGCCGATTGTTACCTCTCGCCATTCAGGTTGACCTTGAAGGTGACCAAGTAAAAATAC

TTACGCCAAAAAGCCCAGAGTTACTTTGGACAATTGCCAAAATGTGCTTCTCTATTGCCGATGTCAATGTCCAT

GAAATGTCGACTCACTTAGGGCGGGCACATTTTGCCCAAGAATCCTTTGGAGCGATTACCCCCTGTCAACTAG

CGCCTAAACACCCACTAGCAATTTTACTAAAACCCCATCTGCGTTTTCTGGTGGCTAATAATCAAGCCGGTATT

GAAAAACTTGTGAACACAGGTGGCCCCGTAGACATGCTGTTAGCTTCAACCCTACAGGGGTCGCTAGATATAA

GTACTACTGCGGCGAAATCTTGGTCAGTGACAGAAACATTCCCCGAATCAATACAAGCAAGAAATGTTGCTTC

AGAGGAATCGTTACCCCATTACCCTTATCGGGACGATGGTATTTTGATATGGGATGCTGTGGTTGGTTACGTT

AACGAATACGTCAATATCTATTATAAAAATGAAGAAGATGTAGTGAAGGATTATGAATTGCAGGCATGGGCT

AAAAACTTAGCAGATACCGGCGTCCACGGTGGAAACATCAAAGATATGCCGAGCCAGATAGAGAGTATCAAA

CAACTATCACAACTCCTTTCTGTCATCATTTTCCATAATAGTGCCGGACATAGTTCTATCAATTACCCACAATATC

-continued

CCTGTATAGGTTTTTGCCCTAATATGCCTTTAGCGGGTTATAGCAATTACCGTGAATTCCTGGCTAAGGAGAAA

ACAACACAAGAGGAGCAGCTCACCTTTTTACTAAGCTTCGCACCACCCCAAGCATTAGCCTTAGGGCAGATCG

ATATCACAAACTCTCTGTCCATTTATCATTATGATACTTTGGGCGATTATGCAAAAGAGTTAACCGACCCTTTGG

CAAAACACGCTCTATACTGTTTCACTCAAAAATTGACAGCTATTGAACAACAGATTGAGGTCAGAAACAGTCA

ACGGGCCGAGCCTTATAAGTACATGTTGCCGTCTGAAATTTTGAATAGCGCCAGCATTTAA

Amino acid Sequence for OUS02327.1

SEQ ID NO: 162

MVGHDGPKYAHESNQPSLPQNDTPAEQEARRTALGLTQEKYHLSNDNDLGLPLLKEVPAEEAFSNIYEAGRAIDTF

PLLENHDKVMSQLTNPYGPFTGLADYESMFIDIPKPAVTKNWLTDESFGEQRLSGVNPVMIERVKNAKDLASKFN

VSQLKDVLDSDINLDELIKDELLYITDLSPYLKDIPEGKVPSPGGYIPKYLPKPIGLFYWHKDGAKLKDPSLKSGRLLPLA

IQVDLEGDQVKILTPKSPELLWTIAKMCFSIADVNVHEMSTHLGRAHFAQESFGAITPCQLAPKHPLAILLKPHLRFL

VANNQAGIEKLVNTGGPVDMLLASTLQGSLDISTTAAKSWSVTETFPESIQARNVASEESLPHYPYRDDGILIWDAV

VGYVNEYVNIYYKNEEDVVKDYELQAWAKNLADTGVHGGNIKDMPSQIESIKQLSQLLSVIIFHNSAGHSSINYPQY

PCIGFCPNMPLAGYSNYREFLAKEKTTQEEQLTFLLSFAPPQALALGQIDITNSLSIYHYDTLGDYAKELTDPLAKHAL

YCFTQKLTAIEQQIEVRNSQRAEPYKYMLPSEILNSASI

Coding sequence for WP_106300061.1

SEQ ID NO: 163

ATGCTCCAACCGAGTTTGCCCCAAGACGATACCCTCGATCGACAGCAGCAGCGAAATCAGGCGATCGCGCAG

CAGCGAGAAGATTATCAATATAGCCAGACAGCCGGGATCCTGCTAATTAAAGAGTTGCCCCAGTCGGAAATG

TTTTCACTCAAATACTTATTGGAGCGAGATGCTGGGTTAGTATCTTTAATTGCAAATACTTTGGCAAGCAGTAT

CGAAAATGTCTTCGATCCCTTCGATAAATTAGAAGATTATCAGGAGATGTTTCCACTGTTACCCAAACCCTCGG

TCTGGGAAACATTCCGCAATGATGCTGTTTTTGCCCGTCAGCGTATTGCTGGTGCCAACCCGATGGTAATCGA

GCGTGTAATTGACAAGTTGCCCGATAACTTTCCAGTTACAGATGCCATATTCCAAAAAATCATGTTAACTAAAA

AAACTCTGGCAGAGGCAATTGCTGAGGGAAGAATCTTCCTCACCAATTATCAAGGGCTGGATGGACTCAAGC

CAGGAGGCTACCAATACGAACGGGATGGACAACAAGTTAAAGTAACAAAAACTATTGCCGCGCCCTTAGTAT

TGTACTGCTGGAAACCCACAGGTTATGGAGATTATCGTGGTAATTTAGCACCGATCGCCATTCAAATCAATCA

GCAACCCGATCCGATCGCCAATCCAATTTATACCCCAAGAGACGGAAGGCATTGGTTGATGGCAAAAATCTTT

GCTCAGATGGCTGATGGAAACTATCACGAAGCTATCAGTCATCTAGGCCGAACTCATTTGGTATTAGAACCTTT

TGTGTTAGCAACCGCCAATGAATTAGCCCCAAATCATCCCCCTTTCAGTTCTGCTCAAACCCCATTTTCAATTTAC

CCTAGCAATCAACGAACTAGCCCGAGAACAATTGATTAGCCCAGGCGGTTATGCAGACGATTTGCTAGCCGG

AACTCTAGAAGCCTCGATCGGTGTAATTAAAGCAGCCATCAAAGAATACCTAGAAAACTTCACTGAGTTTGCC

ATACCTAAAGAACTCACCCGGCGAGGAGTAGGGGAAACCGATGTGGATGGATCGGGAGAAAAITTTTTGCCA

GACTACCCCTATAGAGATGATGCTCTACTATTGTGGAACGCAATTAAAGTTTACGTCAGTGATTATCTAAACCT

CTACTACACGTCTTCAGCCAAGATTATTGGCGATCCGGAACTACAGAATTGGGCGAAAAAGCTGATTTCTCCA

GAGGGGGGTAATGTCACGGGTTTAGTTCCCAATGGTCAACTGACAACGCTAGAACAACTTGTCGAGATCGTC

ACCCAATTAATTTTTGTCAGTGGCCCTCAACATGGTGCGGTGAACTATCCTCAGTATGACTATATGGCATTTGT

ACCCAATATCCCGCTGGCTACCTATGGAAATCCGCCCAGCCGCGATGTGGAAATTAATGAGGAGACCATTTTA

AATATTCTGCCACCACAAAAGTTGGCAGCCAAGCAACTGGAATTGATGAGAACTCTCTCTGTTTTCCGGGCAA

ATCGTTTAGGGTATCCAGATCGAGAATTCGTCGATGTTCGCGCTCGGGGAGTGTTGCAGAAATTTCAAGCAAG

ATTGCAAGAAATCGAACAAGAAATTTCGGTACGGAATGAAACTCGACTCGAACCATATCTATTTCTCTTGCCCT

CCAATGTGCCAAATAGTTTAAATATTTAA

-continued

Amino acid Sequence for WP_106300061.1

SEQ ID NO: 164

MLQPSLPQDDTLDRQQQRNQAIAQQREDYQYSQTAGILLIKELPQSEMFSLKYLLERDAGLVSLIANTLASSIENVF

DPFDKLEDYQEMFPLLPKPSVWETFRNDAVFARQRIAGANPMVIERVIDKLPDNFPVTDAIFQKIMLTKKTLAEAIA

EGRIFLTNYQGLDGLKPGGYQYERDGQQVKVTKTIAAPLVLYCWKPTGYGDYRGNLAPIAIQINQQPDPIANPIYTP

RDGRHWLMAKIFAQMADGNYHEAISHLGRTHLVLEPFVLATANELAPNHPLSVLLKPHFQFTLAINELAREQLISP

GGYADDLLAGTLEASIGVIKAAIKEYLENFTEFAIPKELTRRGVGETDVDGSGENFLPDYPYRDDALLLWNAIKVYVS

DYLNLYYTSSAKIIGDPELQNWAKKLISPEGGNVTGLVPNGQLTTLEQLVEIVTQLIFVSGPQHGAVNYPQYDYMAF

VPNIPLATYGNPPSRDVEINEETILNILPPQKLAAKQLELMRTLSVFRANRLGYPDREFVDVRARGVLQKFQARLQEI

EQEISVRNETRLEPYLFLLPSNVPNSLNI

Coding sequence for WP_099065794.1

SEQ ID NO: 165

ATGACACAGCCAAGTTTGCCCCAAGATGATAGCCCTGAGCAACAGTTACAGCGAAAGCAAGAGATTGCACGT

CAACGGGAAGATTATCAATATAGCGAAACAGCGGGAATACTTTTGATTAAAGAATTGCCACAGTCAGAAATGT

TTTCATTTAAATATTTACTGGAGCGAGATAAAAGTTTAATATCATTAATCGCCAATACTTTGGCAACTAATATTG

ATAATGTTTTCGATCCCTTCGATAGTTTAGAAGACTATCAACAGATGTTTCCACTGCTGCCCAAACCTTCGACAT

TGCAAACATTCCGCAACGATGGTGTTTTTGCTCGTCAGCGCATTGCTGGTGCTAACCCGATGGTAATTGAACG

GGTAGTGGGAAAATTACCCGATAACTTCGCAGTTACAGATGCCATCTTTCAAAAAATTATGCTAACTCAAAAG

ACGTTAGCACAGGCGATCGCAGAGGGCAGAATTTTCATCACCAATTATCAGGGGCTTGATGGACTCACTCCAG

GAACCTACGAACAAGGAACAAAAACCATTGCTGCTCCCTTGGTGTTGTACTGCTGGAAACCCGTAGGTTATGG

AGATTATCGCGGAAGTTTGACTCCAATTGCCATTCAACTCAATCAGCAACCCCATCCAGAAAACAATCCAATTT

ATACACCAATGGATGGAATGCATTGGTTTATGGCAAAAATCTATGCTCAGATGGCTGATGGCAACTATCATGA

AGCTATCAGCCATCTGGGACGAACTCATTTGGTATTAGAGCCATTTGTCTTAGCAACTGCCAATGAACTAGCAC

CTAATCATCCTCTTTCAGTGTTGCTAAAACCCCATTTTCAATTCACCCTAGCAATCAATGAACTGGCACGGGAAC

AATTGATCAGCCCAGGTGGCTACGCAGATACCTTGCTAGCTGGAACCCTGGAAGCCTCCATCAGCGTTATTAA

AGCAGCTATTAAAGAATATCTGGAAAACTTCAGTGACTTTGCCTTGCCCAAGGAATTAACTAGGCGAGGAGTG

GGGGAAACCGATGTGGATGGACAGGGAGAAAACTTTTTGCCGGACTACCCCTATCGGGATGATGGTTTGCTA

TTGTGGAAAGCAATTGAGGCTTACGTTAGCAATTATTTAGATCTCTATTACACATCTCCAGTCCAGATTATTAA

GGATACAGAACTACAGAATTGGGTGCAAAAGTTAATATCTCCAGAGGGGGGTGGTGTCAAAGGATTAGTGCC

CAATGGTCAATTGCAAACTGTGGAACAGTTAGTGGCCATCGCCACCCAACTAATTTTTATCAGTGGGCCTCAG

CATGGTGCGGTGAACTATCCCCAATACGACTACCTTGCCTTCGTACCCAATATGCCGTTAGCTACTTATGCACC

ACCTCCCAGCCGCGATCGAGAAATTAATGAAGCCACAATCCTGAAGATTCTCCCCCCACAAAAGCTGGCAGCA

AAGCAATTAGAGTTGATGAGAACTCTCACTGTTTTCCAACCAAATCGCTTGGGCTATCCAGACAAGAACTTTGT

CGATGTCCGCGCTCAGAATGTTTTGCGGCAATTCCAGGCAAAATTACAAGAAGTTGAGCAAGTGATTAATCAG

CGAAATCAGACCCGCCTTGAACCTTATACCTTTCTTTTACCCTCGAATGTACCTAATAGCTTAAATATTTAG

Amino acid Sequence for WP_099065794.1

SEQ ID NO: 166

MTQPSLPQDDSPEQQLQRKQEIARQREDYQYSETAGILLIKELPQSEMFSFKYLLERDKSLISLIANTLATNIDNVFDP

FDSLEDYQQMFPLLPKPSTLQTFRNDGVFARQRIAGANPMVIERVVGKLPDNFAVTDAIFQKIMLTQKTLAQAIAE

GRIFITNYQGLDGLTPGTYEQGTKTIAAPLVLYCWKPVGYGDYRGSLTPIAIQLNQQPHPENNPIYTPMDGMHWF

MAKIYAQMADGNYHEAISHLGRTHLVLEPFVLATANELAPNHPLSVLLKPHFQFTLAINELAREQLISPGGYADTLL

AGTLEASISVIKAAIKEYLENFSDFALPKELTRRGVGETDVDGQGENFLPDYPYRDDGLLLWKAIEAYVSNYLDLYYTS

PVQIIKDTELQNWVQKLISPEGGGVKGLVPNGQLQTVEQLVAIATQLIFISGPQHGAVNYPQYDYLAFVPNMPLAT

-continued

YAPPPSRDREINEATILKILPPQKLAAKQLELMRTLTVFQPNRLGYPDKNFVDVRAQNVLRQFQAKLQEVEQVINQR

NQTRLEPYTFLLPSNVPNSLNI

Coding sequence for WP_012596348.1

SEQ ID NO: 167

ATGGTACAACCAAGTTTACCCCAAGATGATACCCCCGATCAACAGGAGCAGCGAAATCGGGCAATCGCACAG

CAACGAGAAGCGTATCAATATAGCGAGACAGCCGGGATACTGTTGATCAAAACCTTGCCTCAGTCGGAAATG

TTTTCATTGAAATACTTGATTGAGCGAGATAAGGGATTAGTGTCCCTAATTGCCAATACCTTAGCCAGCAATAT

CGAGAATATCTTCGATCCCTTCGATAAATTAGAAGATTTTGAGGAAATGTTTCCATTGTTACCCAAACCTCTAG

TAATGAACACCTTCCGCAATGATAGGGTGTTTGCTCGTCAGCGTATTGCTGGTCCTAATCCGATGGTTATTGAG

CGGGTCGTTGACAAATTGCCAGATAACTTCCCTGTGACGGATGCGATGTTTCAAAAAATCATGTTCACGAAAA

AGACTCTAGCAGAGGCAATTGCACAAGGGAAACTCTTTATCACTAATTACAAAGGATTGGCGGAGCTTTCACC

AGGACGCTATGAATATCAAAAAAATGGAACACTCGTCCAAAAAACCAAAACGATCGCGGCTCCGTTAGTATTA

TACGCCTGGAAACCTGAAGGATTCGGCGATTATCGGGGGAGTTTAGCACCGATCGCCATTCAAATCAATCAGC

AACCTGACCCAATAACCAATCCCATTTATACGCCAAGGGATGGGAAGCATTGGTTTATAGCAAAAATCTTTGC

CCAGATGGCTGATGGCAATTGTCACGAAGCAATTAGCCACTTAGCACGAACCCATCTGATCTTAGAACCTTTTG

TGCTGGCAACGGCCAATGAACTCGCACCAAATCATCCTTTATCTGTTCTGCTTAAACCCCATTTCCAATTTACCT

TGGCCATTAATGAACTGGCACGAGAACAGTTGATCAGTGCCGGAGGTTATGCCGATGATCTGCTCGCTGGAA

CCCTTGAAGCCTCTATCGCTGTCATTAAAGCGGCTATCAAGGAATATATGGACAATTTCACTGAGTTTGCTTTG

CCTCGTGAGCTTGCTCGCCGAGGAGTGGGGATAGGGGATGTAGATCAAAGGGGAGAAAACTTCTTGCCGGA

CTACCCCTATCGAGATGACGCGATGCTCTTGTGGAATGCGATCGAGGTTTATGTGAGGGATTATCTCAGTCTTT

ACTATCAATCTCCCGTCCAGATTCGTCAAGATACAGAACTGCAAAATTGGGTTAGGCGACTGGTGTCCCCAGA

AGGGGGTAGGGTCACGGGATTAGTGTCCAATGGGGAACTGAATACAATTGAGGCATTGGTGGCGATCGCAA

CTCAGGTCATTTTTGTCAGTGGTCCTCAGCACGCTGCGGTTAACTATCCCCAATACGACTATATGGCGTTTATTC

CTAATATGCCCCTAGCTACCTATGCCACTCCCCCTAATAAGGAGAGCAACATTAGTGAAGCAACAATCCTCAAT

ATTCTTCCTCCACAAAAGTTGGCAGCAAGGCAACTGGAGTTGATGAGAACGCTGTGTGTTTTCTATCCCAATCG

TTTAGGATATCCCGACACAGAATTTGTGGATGTTCGGGCTCAGCAGGTGCTGCATCAATTTCAAGAAAGATTG

CAGGAAATTGAACAAAGGATCGTCCTATGCAATGAAAAACGACTGGAACCCTATACTTACCTCTTACCTTCAAA

CGTCCCTAACAGTACCAGTATTTAA

Amino acid Sequence for WP_012596348.1

SEQ ID NO: 168

MVQPSLPQDDTPDQQEQRNRAIAQQREAYQYSETAGILLIKTLPQSEMFSLKYLIERDKGLVSLIANTLASNIENIFD

PFDKLEDFEEMFPLLPKPLVMNTFRNDRVFARQRIAGPNPMVIERVVDKLPDNFPVTDAMFQKIMFTKKTLAEAIA

QGKLFITNYKGLAELSPGRYEYQKNGTLVQKTKTIAAPLVLYAWKPEGFGDYRGSLAPIAIQINQQPDPITNPIYTPR

DGKHWFIAKIFAQMADGNCHEAISHLARTHLILEPFVLATANELAPNHPLSVLLKPHFQFTLAINELAREQLISAGGY

ADDLLAGTLEASIAVIKAAIKEYMDNFTEFALPRELARRGVGIGDVDQRGENFLPDYPYRDDAMLLWNAIEVYVRD

YLSLYYQSPVQIRQDTELQNWVRRLVSPEGGRVTGLVSNGELNTIEALVAIATQVIFVSGPQHAAVNYPQYDYMAF

IPNMPLATYATPPNKESNISEATILNILPPQKLAARQLELMRTLCVFYPNRLGYPDTEFVDVRAQQVLHQFQERLQEI

EQRIVLCNEKRLEPYTYLLPSNVPNSTSI

Coding sequence for WP_036533591.1

SEQ ID NO: 169

ATGCTCCCACCGAGTTTGCCCCAAGATGATACTCCTGATCAGCAGCTACAGCGAAATCAGGCGATCGCGCAAC

AGCGAGAAGACTATCAATATAGCCAGACTGCGGGAATACTACTAATTAAAACGTTGCCTCAATCGGAAATGTT

TTCATTCAAATATTTGCTAGAGCGCGATAAGGGGCTGGTTTCCTTAATTGTGAATACCCTAGCAAGCAAAATCG

AGAATATCTTCGATCCCTTCGAGAAATTAGAAGATTATCAGGAGATGTTTCCACTGTTGCCCAAACCCTCAGTT

-continued

CTAGAAACCTTCCGACATGATGCTGTCTTTGCCCGTCAACGCATTGCGGGTGCAAACCCGATGGTCATTGAGC
GCGTAATTAGCAAATTACCGGATAACTTCCCGGTCACAGATGCCATGTTTCAAAAAATTATGTCAACCAAAAA
GACGTTGGCAGAGGCGATCGCTGAAGGGAGACTCTTCCTCACGAACTATAAGGGGCTGGATGGACTGACCCC
AGGACACTACGAAAGAGGAACAAAAACCATTGCAGCTCCCTTAGTCTTGTACTGCTGGAAACCAACAGGTTAT
GGTGATTATCGCGGGAATTTAGCACCGATCGCCATTCAAATTAATCAGAAACCTGACCCGATAATCAATCCAA
TATATACCCCAAGGGATGGGATGCATTGGTTTATGGCAAAAATCTTTGCCCAGATGGCAGATGGCAACTATCA
CGAAGCGATCAGTCATCTAGGTCGAACGCATCTAGTTTTAGAACCATTTGTGCTGGCCACCGCCAATGAGCTA
GCCCCCAATCATCCTCTTTCCATTCTCCTCAAGCCCCATTTTCAATTCACTCTGGCAATCAATGAACTAGCACGA
GAACAATTGATCAGCAAAGGTGGCTATGCAGATACGCTGCTCGCGGGCACACTGGAAGCCTCCATCAGCGTC
ATTAAAGCAGCCATCCAGGAATACTTCGAAAACTTTACAGAGTTTGCAGTACCGAAAGAGCTAACCCGGCGAG
GCATTGGGGAAACCGATTTAGATGCACAGGGCGAGAATTTCTTACCCGACTACCCCTACCGAGATGATGCACT
GTTATTGTGGGATGCAATTAAAAACTACGTAAGGGATTATCTGAATCTCTACTATACGTCCCAAGACAAAATCC
TCAAGGATACCGAACTAAAGAATTGGGTGAGTAAGCTTATTTCTCCTGAGGGGGGAAATGTCAAAGGATTGG
TTCCCAATGGTGAGCTTACCACCCTAGATCAGTTAGTTGAGATAGCAACGCAGCTAATTTTTGTCAGTGGCCCA
CAACACGCTGCGGTGAATTATCCCCAATACGACTACATGGCCTTTGTCCCTAACATGCCCCTAGCTACCTATGC
CCCTCCGAGTAGCGATCCGACGATCGATGAAACCACGATTCTGAAAATTCTTCCTCCACAAAAACTAGCCGCA
AAGCAATTAGAGCTAATGAAAACTCTTTCTGTTTTTCGGGCAAATCGCTTAGGCTATCCAGACAATGAATTTGT
TGATGTTCGGGCTCAGAATGTATTAATTAAATTTCAGGGAAATTTGAAAAAAGTCGAGGATAAAATTACCGCA
CGGAATGAGACTCGACTTGAGCCGTATGTATTTCTCTTGCCCTCCAACGTACCTAATAGTACAAATATTTAG

Amino acid Sequence for WP_036533591.1

SEQ ID NO: 170

MLPPSLPQDDTPDQQLQRNQAIAQQREDYQYSQTAGILLIKTLPQSEMFSFKYLLERDKGLVSLIVNTLASKIENIFD
PFEKLEDYQEMFPLLPKPSVLETFRHDAVFARQRIAGANPMVIERVISKLPDNFPVTDAMFQKIMSTKKTLAEAIAE
GRLFLTNYKGLDGLTPGHYERGTKTIAAPLVLYCWKPTGYGDYRGNLAPIAIQINQKPDPIINPIYTPRDGMHWFM
AKIFAQMADGNYHEAISHLGRTHLVLEPFVLATANELAPNHPLSILLKPHFQFTLAINELAREQLISKGGYADTLLAGT
LEASISVIKAAIQEYFENFTEFAVPKELTRRGIGETDLDAQGENFLPDYPYRDDALLLWDAIKNYVRDYLNLYYTSQDK
ILKDTELKNWVSKLISPEGGNVKGLVPNGELTTLDQLVEIATQLIFVSGPQHAAVNYPQYDYMAFVPNMPLATYAP
PSSDPTIDETTILKILPPQKLAAKQLELMKTLSVFRANRLGYPDNEFVDVRAQNVLIKFQGNLKKVEDKITARNETRLE
PYVFLLPSNVPNSTNI

Coding sequence for WP_015784471.1

SEQ ID NO: 171

ATGGTACAACCAAGTTTACCCCAAGATGATACCCCCGATCAACAGGAGCAGCGAAATCGGGCAATCGCACAG
CAACGAGAAGCGTATCAATATAGCGAGACAGCCGGGATACTGTTGATCAAAACCTTGCCTCAGTCGGAAATG
TTTTCATTGAAATACTTGATTGAGCGAGATAAGGGATTAGTGTCCCTAATTGCCAATACCTTAGCCAGCAATAT
CGAGAATATCTTCGATCCCTTCGATAAATTAGAAGATTTTGAGGAAATGTTTCCATTGTTACCCAAACCTCTAG
TAATGAACACCTTCCGCAATGATAGGGTGTTTGCTCGTCAGCGTATTGCTGGTCCTAATCCGATGGTTATTGAG
CGGGTCGTTGACAAATTGCCAGATAACTTCCCTGTGATGGATGCGATGTTTCAAAAAATCATGTTCACGAAAA
AGACTCTAGCAGAGGCAATTGCACAAGGGAAACTCTTTATCACTAATTACAAAGGATTGGCGGAGCTTTCACC
AGGACGCTATGAATATCAAAAAAATGGAACACTCGTCCAAAAAACCAAAACGATCGCGGCTCCGTTAGTATTA
TACGCCTGGAAACCTGAAGGATTCGGCGATTATCGGGGGAGTTTAGCACCGATCGCCATTCAAATCAATCAGC
AACCTGACCCAATAACCAATCCCATTTATACGCCAAGGGATGGGAAGCATTGGTTTATAGCAAAAATCTTTGC
CCAGATGGCTGATGGCAATTGTCACGAAGCAATTAGCCACTTAGCACGAACCCATCTGATCTTAGAACCCTTT

-continued

GTGCTGGCAATGGCCAATGAACTTGCACCAAATCATCCTTTGTCTGTTCTGCTTAAACCCCATTTCCAATTTACC

TTGGCTATTAATGAACTGGCACGAGAACAGTTGATCAGTGCCGGAGGTTATGCCGATGCTCTGCTGGCTGGA

ACCCTTGAAGCCTCTATCGCTGTCATTAAAGCGGCCATCAAGGAATATATGGACAATTTCACTGAGTTTGCTTT

GCCTCGGGAGCTTGCTCGGCGAGGAGTGGGGGTAGCAGATGTGGATCAAACGGGAGAAAACTTCTTGCCGG

ACTACCCCTATCGAGATGATGCGATGTTATTGTGGAATGCGATCGAGGTTTATGTGAGGGATTATTTAAGTCT

TTACTATCAATCTCCTGTCCAAATTCGTCAAGATACAGAACTACAAAATTGGGTTAGGCGACTGGTGTCTCCAG

AAGGGGGTAGCGTCACGGGATTAGTGCCCAATGGGGAACTGAATACAATTGAGCAACTGGTGGCGATCGCA

ACTCAGGTCATTTTTGTCAGTGGTCCTCAGCACGCTGCGGTCAACTATCCCCAATACGACTATATGGCGTTTAT

TCCCAATATGCCCCTAGCTACCTATGCCACTCCCCCTCATAAAGATAGCAACATTAGTGAAGCAACCATCCTCA

ATATTCTTCCTCCACAAAAGTTGGCAGCAAGGCAACTGGAGTTGATGAGAACGCTGTGTGTTTTCTATCCCAAT

CGTTTAGGATATCCAGACACAGAATTTGTAGATGTCCGTGCGCAGAGGGTGCTGCATCAATTTCAAGAAAGAT

TGCAGGAAATTGAACAAAGGATCGTCCTATGCAATGAAAAACGACTGGAACCGTATACTTACCTCTTACCTTC

AAATGTCCCTAACAGTACCAGTATTTAG

Amino acid Sequence for WP_015784471.1

SEQ ID NO: 172

MVQPSLPQDDTPDQQEQRNRAIAQQREAYQYSETAGILLIKTLPQSEMFSLKYLIERDKGLVSLIANTLASNIENIFD

PFDKLEDFEEMFPLLPKPLVMNTFRNDRVFARQRIAGPNPMVIERVVDKLPDNFPVMDAMFQKIMFTKKTLAEAI

AQGKLFITNYKGLAELSPGRYEYQKNGTLVQKTKTIAAPLVLYAWKPEGFGDYRGSLAPIAIQINQQPDPITNPIYTP

RDGKHWFIAKIFAQMADGNCHEAISHLARTHLILEPFVLAMANELAPNHPLSVLLKPHFQFTLAINELAREQLISAG

GYADALLAGTLEASIAVIKAAIKEYMDNFTEFALPRELARRGVGVADVDQTGENFLPDYPYRDDAMLLWNAIEVYV

RDYLSLYYQSPVQIRQDTELQNWVRRLVSPEGGSVTGLVPNGELNTIEQLVAIATQVIFVSGPQHAAVNYPQYDY

MAFIPNMPLATYATPPHKDSNISEATILNILPPQKLAARQLELMRTLCVFYPNRLGYPDTEFVDVRAQRVLHQFQER

LQEIEQRIVLCNEKRLEPYTYLLPSNVPNSTSI

Coding sequence for WP_094531790.1

SEQ ID NO: 173

ATGATCTTCTCGCTTTTGAGTGGTGTTGCCAGAATATTAAATTTTGTCGCGGCGAAGTTAGTAGACTTAGCTGA

TTGGATATCAAGGCGATCGCCTTCCAGCAAGTATCCACTGCTGCCCCAGAATGATCCTGAAATAAATCAGCGT

CAAGCATTTCTCAATAATGCCAGACAACTTTACCAATACAACTATACTTACATCGACTCGTTGCCAATGGTGGA

GACAGTTCCCACCATTGAGAGATTCTCTTTATCTTGGGGTTTACTCGTTGGCAAAGCTGTAGTCACGGTTTTGC

TGAATGAAAGAGCTAATCTATCATTGGAAAAAGATAAACTAGCTTCTCAAGCCAAGCAACGAGAATTTTCAAA

ACGTTTATTAGAGGCTGGAATGTCTCACTCAGACACAGCCATATTGGATCTATTAGACGAATTGCCAACAGTTT

TAGAAACTCCGCCATCTGATTTAGAAGGGGTAAATATTGAAGAATATAACAATCTATTTTGGGTTATTCCTCTT

CCTACGATCAGTCAAAACTATATCAGTAACACTGAATTCGCGAGATTGCGAGTTGCTGGGTTTAATCCCTTAGT

GATTCAACGAGTTAAAGCATTAGATGCAAGGTTCCCTTTAACAGAGGAGCAATTCCAGACAGTTTTGCCAAAT

GATTCTTTAGCCTTAGCAGGAGCCGAGGGTCGTTTGTATTTAGCCGATTATGCAGAACTAGAGGCGATCGCTG

GTGGTACATTTCCCACAGGAGAGCAAAAATATGTCAATGCTCCTTTAGCTCTGTTTGCCATTCCACAAGGAGAA

AGAAGTCTGACTCCGATCGCAATTCAACTGGGGCAAGACCCGAATATCAATCCCATCTTTTTGCGCCGAGTTG

GTGACGAACCGAACTGGTTGATTGCTAAAACTGTTGTTCAAATTGCTGATGCTAATCACCATCAACTGATTAGC

CATTTGGGTAGAACCCATTTATTTGTCGAACCATTTGTAATTGCCACCAATCGCCAACTTGCCAGCAATCATCCT

CTGTATATTTTACTGAAACCCCATTTCCAAGGGACTTTAGCGATCAATGACGCAGCGCAGTCAAACCTAGTTAG

CGTTGGTGGTGGTGTTGATAGTTTGCTAGCAGGGACGATTGCAAGTTCTCGCGCTGTTTCTGTACATGGGGTT

AAGTCTTATCAATTTGAAGATGCGCTCCTTCCTAATGCACTCAAGAAACGCGGCGTTGATGATCCCAGCTTATT

GCCAGACTATCCCTATCGCGACGATGCGTTATTAATTTGGGAAGCGATCGCTACTTGGGTGAAGAGTTATCTA

-continued

TCGATTTATTATTTCAATGATGATGCTGTGGTTCGCGATACGGAACTGCAAGCATGGGCAAAGGAAATCATTG

CTAATGATGGTGGTCGGGTGACTAGCTTTGGTGAAAATGGACAGATTCGGACTTTATCCTATTTAGCTGATGC

CCTGACTGCGGTGATCTTCACAGGTAGCGCTCAACATGCGGCAGTGAATTTCCCGCAGGGAGATCTGATTGTT

TATACGCCTGCGATTCCTTTGGCGGGTTATACACCTGCGCCAACTCAGACTACAGGTGCAGAAGAAGCAGATT

TCTTTGCGATGTTGCCGCCGATCGAACAAGCTAAGGGACAATTGAAACTAACTTATATTCTCGGTTCGGTCTAT

TACACGACACTGGGAGATTATGGTACTGATTATTTCAGCGACGATCGCATTCAGCAGCCTTTACGCGATTTTCA

AGATCTGTTAAAGGAGATCGAATCTACGATCAAGTCTCGCAATGAACAACGAGTTGCAGATTATAACTATTTG

AGACCATCACGGATTCCCCAAAGCATTAATATCTAA

Amino acid Sequence for WP_094531790.1

SEQ ID NO: 174

MIFSLLSGVARILNFVAAKLVDLADWISRRSPSSKYPLLPQNDPEINQRQAFLNNARQLYQYNYTYIDSLPMVETVPT

IERFSLSWGLLVGKAVVTVLLNERANLSLEKDKLASQAKQREFSKRLLEAGMSHSDTAILDLLDELPTVLETPPSDLEG

VNIEEYNNLFWVIPLPTISQNYISNTEFARLRVAGFNPLVIQRVKALDARFPLTEEQFQTVLPNDSLALAGAEGRLYLA

DYAELEAIAGGTFPTGEQKYVNAPLALFAIPQGERSLTPIAIQLGQDPNINPIFLRRVGDEPNWLIAKTVVQIADANH

HQLISHLGRTHLFVEPFVIATNRQLASNHPLYILLKPHFQGTLAINDAAQSNLVSVGGGVDSLLAGTIASSRAVSVHG

VKSYQFEDALLPNALKKRGVDDPSLLPDYPYRDDALLIWEAIATWVKSYLSIYYFNDDAVVRDTELQAWAKEIIAND

GGRVTSFGENGQIRTLSYLADALTAVIFTGSAQHAAVNFPQGDLIVYTPAIPLAGYTPAPTQTTGAEEADFFAMLPP

IEQAKGQLKLTYILGSVYYTTLGDYGTDYFSDDRIQQPLRDFQDLLKEIESTIKSRNEQRVADYNYLRPSRIPQSINI

Coding sequence for PZO42668.1

SEQ ID NO: 175

ATGGTCTTCTCGCTTTTGAGTGGTGTTGCCAAAACATTAAATTTCGTCGCATCTAAGTTGAAAGACTTGGCTGA

TTGGATATCAAGGCGATCGCCTTCTAGCAAATATCCGCTACTGCCCCAGAACGATCCTGAAATAAAGCAGCGT

CAATCGTTTCTAGATAATGCAAGGCAACTCTATCAATATAACTACACCTACATTGACTCGCTCCCACTGGTGGA

AACAGTTCCCACCAATGAGAGATTTTCTTTGTCTTGGGGATTGCTAGTTGGCAAGGCAGCAATCAAGGTTTTG

CTGAATGAGCGGGCGAATCCATTGTTGTTGGAAGCGGGGAAACAAACCTCTAAGGCTAAGCAACAAGACTTC

TCAAAACGTTTGCTGGAAGCTAGTGTAGCTCAGTCAGAATCTGCCCTATTGGAACTATTGGAAGATTTGCCAA

CGGTTTTAGAAACTCCACCCAGTGAATTAGAAGGGGTGAATATTGAAGAGTATAACAATTTGTTTTGGGTTAT

TCCTCTTCCCTCGATCAGTCAAAACTATACCAGTAATAAAGAATTCGCCAGATTGCGAGTTGCTGGGTTTAATC

CCTTAGTGATTCAACGAATTACAGCCCTAGATGCAAGATTTCCTTTAACTGAAGCGCAATTCCAGAAGGTTCTA

CCCAATGATTCTTTGGCTGTAGCAGGAGCCGAAGGTCGTTTGTATTTAGCCGATTATGCGGAACTAGAGGCGA

TCGTTGGTGGCACATTTCCCACGGGAGAGCAGAAATATATCAATGCTCCTTTAGCGCTGTTTGCCATTCCTCAA

GGGGAAAAGAGCCTGACTCCGATCGCCATTCAACTAGGACAAGACCCCAATACCCATCCCATCTTTTTGCACC

AAGTCGGTGACGAACCAAACTGGTTAATTGCTAAAACTGTTGTTCAAATTGCCGATGCCAATCACCATCAACT

GATTAGTCATTTGGGTAGAACTCATTTATTTGTCGAACCCTTTGTAATTGCTACTAATCGCCAACTTGCAAGCAA

TCATCCTTTGTATATCTTGCTGAAGCCACATTTTCAAGGGACTTTGGCAATTAATGACGCAGCACAGTCCAAAC

TGGTTAGCGCTGGTGGCGGTGTTGATAGTTTGCTAGCAGGTACGATTGAGAGTGCTCGCGCTGTTTCCGTACA

TGGGGTCAAAACCTATAAATTTGAAGATGCGCTGCTACCTAAAGCCCTGAAAAAACGTGGCGTTGACGATCCC

AACTTATTGCCAGATTATCCCTATCGTGATGATGCTTTATTAGTTTGGGAAGCGATCGCTACTTGGGTGAAAAA

TTATCTATCAATCTATTACTTCAATGATGAAGATGTGATTAGAGATACGGAACTGCAAGCATGGGCAAAGGAA

ATCATCGCTAATGATGGTGGTCGGGCGACTAGCTTCGGTGAAAATGGGCAGATTCGGACTTTATCCTATTTAG

CTGATGCTTTGACTGCGGTGATCTTTACAGGTAGCGCTCAACATGCGGCGGTAAACTTCCCACAGGGTGATTT

GATTGTTTATACGCCTGCGATTCCCTTGGCGGGTTATACGCCTGCACCAACTCAGACTACAGGTGCAACCGAA

-continued

GCCGATTTCTTTTCACTCCTTCCGCCAATTGAGCAAGCTAAGGGACAATTGAAACTAACCTATATTCTCGGCTC

AGTCTATTACACAACGCTGGGAGAATATGGTGATGGTTATTTCACTGACGATCGCATTGAGAAGCCATTACGG

GATTTTCAAGATAATTTGAAAGCGATCGAGTCAGAAATCAAGTCTCGCAACGAAAAACGAGTTGCAGATTACA

ATTATTTGAAACCATCACGGATTCCTCAAAGTATCAATATCTAA

Amino acid Sequence for PZO42668.1

SEQ ID NO: 176

MVFSLLSGVAKTLNFVASKLKDLADWISRRSPSSKYPLLPQNDPEIKQRQSFLDNARQLYQYNYTYIDSLPLVETVPT

NERFSLSWGLLVGKAAIKVLLNERANPLLLEAGKQTSKAKQQDFSKRLLEASVAQSESALLELLEDLPTVLETPPSELE

GVNIEEYNNLFWVIPLPSISQNYTSNKEFARLRVAGFNPLVIQRITALDARFPLTEAQFQKVLPNDSLAVAGAEGRLY

LADYAELEAIVGGTFPTGEQKYINAPLALFAIPQGEKSLTPIAIQLGQDPNTHPIFLHQVGDEPNWLIAKTVVQIADA

NHHQLISHLGRTHLFVEPFVIATNRQLASNHPLYILLKPHFQGTLAINDAAQSKLVSAGGGVDSLLAGTIESARAVSV

HGVKTYKFEDALLPKALKKRGVDDPNLLPDYPYRDDALLVWEAIATWVKNYLSIYYFNDEDVIRDTELQAWAKEIIA

NDGGRATSFGENGQIRTLSYLADALTAVIFTGSAQHAAVNFPQGDLIVYTPAIPLAGYTPAPTQTTGATEADFFSLLP

PIEQAKGQLKLTYILGSVYYTTLGEYGDGYFTDDRIEKPLRDFQDNLKAIESEIKSRNEKRVADYNYLKPSRIPQSINI

Coding sequence for WP_106893977.1

SEQ ID NO: 177

ATGAGTCTTTTTTCACGCGTTCGTCCGACCCTTCCGCAGAACGACTCCCCCGCAGCGCAGCAGCAGCGCCAAG

AGGCATTGCTGGACGAACAGAGCAAGTATGTCTGGAAAGATGATTTCGAGACGCTTCCGGGAATCCCTTTGG

CGGCAAGCGTGCCGCGCGACGATCGGCCAACCATCACCTGGCTCTTAGAAGTGGCGGACGTCGGCATCGACA

TTGTGGCCAACCAAATCCTGGCCCAAACGGGCCGCGGTGACTCACTCAAATCGCAGACTGCGGCCGCTGCGA

TCAGACCACATTTGGATAGCATGCGTCAGACCATAGCGACGATTCGCAGCGAGCAGAAGGCGACCCCGGACA

GCCCGCTTCGAATCGTCGACCATGTGGCCGGGACGCTGCTCAGTCTGCATCGCTCCCGCCTGGACAACGAGTT

GAAAACGCTGCAGAACATGATTGCGGCAACCTACCTCGGCAAGCTGGAAAACCCGAGCCTGGAGCAGTATCG

AAAGCTGTTTGTCACGCTGCCCTTGCCGGCAATCGCCGATACCTTCATGGACGACGCGACATTTGCCCGGATG

CGCGTCGCCGGGCCGAACAGCGTGCTGATTGCCGGCCTGAGTGCCTGGCCGTTGAAGTTTGGGCTCAGCGAG

GCGCAGTATCAATCGGTGATGGGCACCAACGATAGTCTGGCCTCGGCGTTAACCGAGCAGCGGCTCTACTGG

CTCGATTACGAGGAACTGAGCACTCTGAAAACGGGCACCACTGGTGGAAAGCCCAAGTTCTTATGTGCCCCGC

TCGCGCTGTTTGCGATCCCGAAGGGCGGTGGCGCGCTGACGCCGGTTGCCATTCAGCTCGGACAATCACCGG

CAGACGGCTTGTTCCTCCGGGTCAGCGACCAGAACAGTCCTGACTGGTGGTCGTGGCAGATGGCCAAGACGT

TCGTACAGGCCGCCGAGGGCAACTATCATGAGCTGTTTGTGCATCTCGCCCGCACGCACCTCGTCATCGAGGC

ATTTGCCGTCGCGACGCATCGGCGGCTGGCGCCCGAGCACCCGCTGAACGTGCTGTTGCTGCCGCATTTTGAA

GGCACCCTGTTCATCAACAATTCTGCGGCAGGCAGTTTGATTGCTGAAGGTGGTCCGATCGACCATATTTTTGC

TGGACAGATCACCTCCACCCAGACCCTCGCCGGTAGCGACCGGCTGGCGTTTGATGTCACCGCACACATGCTG

CCCAACGACTTGGCCAGCCGTCGTGTTGCCGACGTCGCCGCACTCCCTGACTACCCGTATCGCGATGACGCAC

TGCTGGTCTGGCAGGCGATTCAAGACTGGGTCCGGCAATACGTCAGCGTCTACTATCTGAACGATGCCAACGT

CGCGGGCGACACCGAACTGCAAGGTTGGCGTGACGAGTTGCTCGGGCTCGGCAAAATCAAGGGGCTGCCGG

AACTCAAGGACCGTGAGACGCTGATCAGCGTGGTGACGATGGTTATCTTTACGGCCAGTGCTCAGCACGCCG

CGGTGAACTTCCCGCAGAAGGACTTGATGAGCTTTGCACCCGCAATCAGCGGAGCCGCGTGGGCGCCGGTGC

CTAAGCCCGATCAGCCGCAATCGGAGGCGGCCTGGCTGAAACTGTTGCCGCCGATCAAGGAAGCACAAGAGC

AGTTGAACGTGCTGTGGTTACTCGGATCGGTGCACTATCGGCCGCTCGGTGACTACCGGGTGAACCATTGGCC

GTATCTGCCCTGGTTTCAAGATCCGCGCATCACGGGCAAGAATGGCCCCGCTGGCACGTTTCAAACTGGCATTG

AAGGCGGTGGAGATGGAAATCGATAACCGGAACGCCGAGCGCGAGGTGCCGTATCCTTATCTGCAGCCGAG

TTTGATTCCGACCAGCATCAACATCTGA

-continued

Amino acid Sequence for WP_106893977.1

SEQ ID NO: 178

MSLFSRVRPTLPQNDSPAAQQQRQEALLDEQSKYVWKDDFETLPGIPLAASVPRDDRPTITWLLEVADVGIDIVAN

QILAQTGRGDSLKSQTAAAAIRPHLDSMRQTIATIRSEQKATPDSPLRIVDHVAGTLLSLHRSRLDNELKTLQNMIAA

TYLGKLENPSLEQYRKLFVTLPLPAIADTFMDDATFARMRVAGPNSVLIAGLSAWPLKFGLSEAQYQSVMGTNDSL

ASALTEQRLYWLDYEELSTLKTGTTGGKPKFLCAPLALFAIPKGGGALTPVAIQLGQSPADGLFLRVSDQNSPDWW

SWQMAKTFVQAAEGNYHELFVHLARTHLVIEAFAVATHRRLAPEHPLNVLLLPHFEGTLFINNSAAGSLIAEGGPID

HIFAGQITSTQTLAGSDRLAFDVTAHMLPNDLASRRVADVAALPDYPYRDDALLVWQAIQDWVRQYVSVYYLND

ANVAGDTELQGWRDELLGLGKIKGLPELKDRETLISVVTMVIFTASAQHAAVNFPQKDLMSFAPAISGAAWAPVP

KPDQPQSEAAWLKLLPPIKEAQEQLNVLWLLGSVHYRPLGDYRVNHWPYLPWFQDPRITGKNGPLARFKLALKAV

EMEIDNRNAEREVPYPYLQPSLIPTSINI

Coding sequence for BBC22503.1

SEQ ID NO: 179

ATGATCTTCTCAATTTTGAGCGGTGTCGCCAGAATATTAAATTTCCTCTCGGATAAGCTAGCCAATTTAGCTAAT

TTAATATCTAAGCCATCGAAGTCGAGCAACTATCCACTACTGCCCCAGAATGATCCCGAAATTTCTCAGCGTCA

GGCGTTGCTAAATAAGTCTCGGCAACTGTATCAATACAACTACACCTATATTGATTCGCTGCCGATGGTGGAG

AAAGTGCCAACCAGCGAGAGATTTTCTCTATCTTGGGGATTGTTGGTTGGGAAGGTTGTGGTCAAGGTATTGC

TCAATGATCGCGCTAATCCTGCCGCATTTATTGATAAGGAAAAATCGAAAGCCAAGCAACTGGAATTCTCGAA

GAAGTTGCTTGAGGCGAGTATGGCGAAGTCGGATACGGCTTTGGTGGAATTACTTTCCAACTTACCTGCAATT

CTTGAAGATGATCCCATTGATGTAGCAGGCTCGAATATTCAAGAATACAACGAGCTTTTTTGGATTATTCCCCT

TCCGACAATTAGTCAAAGCTTGTTTAGTAATACTGAATTTGCAAGGTTGCGGGTTGCGGGTTTTAATCCTTTGA

TGATTCAACGGGTAACTTCTCTGGATGCAAGATTCCCTGTAACTGAAGCCCAGTTTCAATCAGTTTTGGCAGAT

GATTCTCTCGCCGCCGCAGGTGCTGAAGGACGCTTGTATTTAGCGGATTATGCCGAATTAGAAGCGCTGACTG

GGGGGACATTTCCGAAGGGTAAGCAGAAATATATTAATGCGCCTTTAGCTCTCTTTGCGGTTCCTAAAGGGAA

AAAGAGTCTGACTCCGATCGCGATTCAGTTAGGGCAAGACCCTAATACGCATCCAATTTTTGTTAGTCAACATG

GGGATGAGCCGAATTGGTTGATTGCGAAAACCGTTGTCCAGATTGCTGATGCTAATTACCATCAACTGATTAG

CCATTTAGGACGTACCCATTTATTCATTGAACCCTTTGCGATCGCTACAAATCGTCAGTTGGCTAACAATCACCC

TCTGTATATTTTGCTGAAGCCCCATTTCCAAGGTACTTTGGCGATTAATGATGCTGCTCAGTCGGGACTGGTGA

GTGCAGGTGGAACTGTTGATAGCTTATTAGCAGGAACTATTGATACTGCTCGCGCCCTATCGGTGCATGGAGT

CAAAACCTATAATTTTGATGAAGCAATGCTACCTGTTGCGCTCAAAAAACGTGGCGTTGACGATCCAAAGTTA

CTGCCTGAATATCCCTATCGCGATGATGCGTTATTGGTGTGGGAAGCGATCGCTACTTGGGTAAAGAACTATC

TCTCTGTTTACTATGAAAATGATAATGATGTTGCTAGGGATTCAGAACTACAAGCATGGGTTAAGGAAATTAC

TGCTAACGATGGCGGTCGGGTAACGAGCTTTGGGCAAAATGGACAGATTCGCACCCTATCCTATTTGGTTGAT

GCTGTGACCCTGCTCATCTTTACCAGTAGCGCCCAGCACGCGGCCGTGAACTTTCCCCAAGGTGACTTGATGG

ACTATGCCCCTGCGGTTCCTTTAGCTGGCTATACTCCTGCGCCCACTAGTACCACTGGTGCAACCATAGATAAT

TTCTGGTCGATGATTCCTGCTATTGATCAGGCAAAAAGTCAGTTAACGATGACCTATATTCTCGGCTCGGTCTA

TTACACGACTTTGGGAGATTATGGCAATGCGTATTTCACTGACGATCGCATTGAGCAGCCCCTGCGCGATTTCC

AAGACAATTTGAAGGCGATTGAGTCTACGATTAAGTCTCGCAATGAGCAGCGAAATGTGGATTATAGTTATCT

CAGACCATCACGCATTCCTCAAAGTATTAATATCTAA

Amino acid Sequence for BBC22503.1

SEQ ID NO: 180

MIFSILSGVARILNFLSDKLANLANLISKPSKSSNYPLLPQNDPEISQRQALLNKSRQLYQYNYTYIDSLPMVEKVPTSE

RFSLSWGLLVGKVVVKVLLNDRANPAAFIDKEKSKAKQLEFSKKLLEASMAKSDTALVELLSNLPAILEDDPIDVAGS

-continued

NIQEYNELFWIIPLPTISQSLFSNTEFARLRVAGFNPLMIQRVTSLDARFPVTEAQFQSVLADDSLAAAGAEGRLYLA

DYAELEALTGGTFPKGKQKYINAPLALFAVPKGKKSLTPIAIQLGQDPNTHPIFVSQHGDEPNWLIAKTVVQIADAN

YHQLISHLGRTHLFIEPFAIATNRQLANNHPLYILLKPHFQGTLAINDAAQSGLVSAGGTVDSLLAGTIDTARALSVH

GVKTYNFDEAMLPVALKKRGVDDPKLLPEYPYRDDALLVWEAIATWVKNYLSVYYENDNDVARDSELQAWVKEIT

ANDGGRVTSFGQNGQIRTLSYLVDAVTLLIFTSSAQHAAVNFPQGDLMDYAPAVPLAGYTPAPTSTTGATIDNFW

SMIPAIDQAKSQLTMTYILGSVYYTTLGDYGNAYFTDDRIEQPLRDFQDNLKAIESTIKSRNEQRNVDYSYLRPSRIP

QSINI

Coding sequence for WP_055077131.1

SEQ ID NO: 181

ATGATCTCTTCGATTTTGCGTGGTATTGCCCAAATATTAAATTTCCTTGCGACTAAGTTGTCCGACTTAGCAAAT

TTAATATTGCGGCGATCGCCTTCAAGTAAATATCCCCTATTACCTCAGAACGATCCCGAAATCGATCGACGACA

GGCTCTGCTCAACCAGTCTAGACAGCTCTATCAATATAACTACACCTATGTCGCCCCCTTGCCGATGGTCGAAA

AAGTGCCAACTGGCGAGCAGTTCTCATTGTCTTGGGGCTTATTGGTAGGAAAGGCAGTTATCGAAATTTTATT

AAATGATATTGCGAATCCTTTCCTCTTGAGTGAAAAGGGTAAAAATGCCTCTAAAGCTAGGCAACAAGACTTC

TCAAAACGTTTACTTGAAGCTGGCGTTGCTCAGTCGAATTCCGCAATAATAGGTCTGCTGTCAGAGATTCCCAC

CCTATTAGAGACCGAACCCACCAACGTCGAAGGTTCAAACATTAAGGAATATAACGATCTTTTTTGGATTATTT

CTTTGCCCAAGATCAGTCAAAATTTTACAACTAATTCCGAGTTTGCAAGGCTCCGCGTCGCTGGATTTAACCCT

GTGACGATCCAACGCATCAAGACCTTAGATGCGAAATTTCCTCTCACGGAAGATCAATTTCAAACGGTGTTAG

CGGGGGACTCTCTCGCTGAGGCTGGAGCACAAGGTCGCTTGTATCTGGCTGATTATGCAGAGCTAACGGCGA

TCGCGGGTGGTACTTTTCCTAAGGGAGCGCAAAAGTATATAAATGCACCTTTGGCATTGTTTGCCGTTCCCAAA

GGACAGCAGAGTTTGACACCGATCGCCATTCAATTAGGGCAAGACCCCAGTGCTTATCCCATCTTTGTCTGTCA

GGCTGATGATGAACCGAACTGGCTTCTAGCTAAAACCGTTGTCCAGATTGCTGATGCCAATTACCACGAACTG

ATTAGCCATTTAGGTAGAACCCATTTATTTATCGAACCCTTTGCGATCGCGACTAATCGCCAACTTGCCAGCAA

TCATCCTTTGTACATTCTGCTCAAGCCTCATTTCCAAGGAACTTTAGCGATCAATGATGCCGCTCAATCGGGACT

GATTAGTGCTGGTGGAACCGTGGATAGTCTACTAGCGGGAACGATCGCTTCCTCGCGCACCCTGTCGGCACA

GTCCGTTGAAAACTATAACTTCAATGAAGCGATGTTGCCTGTAGCCCTGAAAAAGAGGGGAGTGGACGATGT

CAATATGCTGCCCGATTATCCCTATCGCGATGATGCTTTATTGGTCTGGGGAGCGATCGCAACTTGGGTCAAA

AACTATCTATCCATCTATTATTTCAGCGATACCGATGTCATGAGAGATGTGGAACTGCAAGCATGGGCAAAGG

AAATTACCTCGATTGATGGCGGGCGCGTCAAGAGTTTTGGTCAAAATGGTCAGATTCAGACCTTTGATTATTT

GGTCGATGCGGTGACATTGCTGATCTTTACCAGCAGCGCCCAACATGCGGCAGTAAACTTCCCTCAAGGCGAT

TTGATGGACTACACGCCAGCAATTCCGCTAGCAGGCTATACTCCCGCACCAACGGCAACCACTGGTGCAACGG

AAGCAGATTTCTTTGCCATGCTACCGCCCATCGACCAAGCTAAGAGTCAATTGACCATGACCTATATTTTGGGC

TCTGTTTATTACACGACCCTAGGCGACTATGGTTCAGATTATTTCAACGACGATCGCCTTCAGCAACCCTTACG

CGATTTTCAAGATGGGTTAAAAGCGATCGAGTCTACAATTAAGTCGCGCAATGAGACTAGGGCTGCTGATTAC

AATTACTTAAAACCATCACGGATTCCTCAAAGCATTAATATCTAA

Amino acid Sequence for WP_055077131.1

SEQ ID NO: 182

MISSILRGIAQILNFLATKLSDLANLILRRSPSSKYPLLPQNDPEIDRRQALLNQSRQLYQYNYTYVAPLPMVEKVPTG

EQFSLSWGLLVGKAVIEILLNDIANPFLLSEKGKNASKARQQDFSKRLLEAGVAQSNSAIIGLLSEIPTLLETEPTNVEG

SNIKEYNDLFWIISLPKISQNFTTNSEFARLRVAGFNPVTIQRIKTLDAKFPLTEDQFQTVLAGDSLAEAGAQGRLYLA

DYAELTAIAGGTFPKGAQKYINAPLALFAVPKGQQSLTPIAIQLGQDPSAYPIFVCQADDEPNWLLAKTVVQIADAN

YHELISHLGRTHLFIEPFAIATNRQLASNHPLYILLKPHFQGTLAINDAAQSGLISAGGTVDSLLAGTIASSRTLSAQSV

ENYNFNEAMLPVALKKRGVDDVNMLPDYPYRDDALLVWGAIATWVKNYLSIYYFSDTDVMRDVELQAWAKEITS

-continued

IDGGRVKSFGQNGQIQTFDYLVDAVTLLIFTSSAQHAAVNFPQGDLMDYTPAIPLAGYTPAPTATTGATEADFFAM

LPPIDQAKSQLTMTYILGSVYYTTLGDYGSDYFNDDRLQQPLRDFQDGLKAIESTIKSRNETRAADYNYLKPSRIPQSI

NI

Coding sequence for WP_009629598.1

SEQ ID NO: 183

ATGATCTCTTCGATTTTGCGTGGTATTGCCCAAATATTAAATTTCCTTGCGACTAAGTTGTCCGACTTAGCAAGT

TTAATATTGCGGCGATCGCCTTCAAGTAAATATCCCCTATTACCTCAGAACGATCCCGAAATCGATCAACGACA

GGCTCTGCTCAACCAGTCTAGACAGCTCTATCAATATAACTACACTTACGTCGCCCCCTTGCCGATGGTCGAAA

AAGTGCCAACTAGCGAGCAGTTCTCATTATCTTGGGGCTTATTGGTAGGAAAGGCAGCGATCGAAGTTTTATT

AAATGATATTGCGAATCCTTTCCTCTTGAGTGAAAAGGGTAAAAATGCCTCTAAAGCTAGGGAGCAAGACTTC

TCAAAACGTTTACTTGAAGCTGGCATTGCTCAGTCGAATTCCGCAATAATAGGGCTACTGTCAGAGATTCCCTC

CCTATTAGAGACCGAACCAACCAATGTTGAAGGTTCAAATATTAAGGAATATAACGATCTTTTTTGGATTATTT

CTTTACCCACGATCAGTCAAAGTTTTACAACTAATTCCGAGTTTGCAAGGCTTCGCGTCGCTGGATTTAACCCT

GTGACGATCCAACGTATCAAGACCTTAGATGCGAAATTTCCTCTCACGGAAGATCAATTTCAAACAGTGTTAG

CGGGGGACTCTCTCGCTGAGGCTGGAGCGCAAGGTCGCTTGTATCTGGCTGATTATGTAGATCTAACGGCGA

TCGCGGGCGGTACGTTTCCTAAAGGAGCACAAAAGTATATAAATGCACCTTTGGCTCTGTTCGCAGTTCCCAA

AGGACAGCAGAGTTTGACCCCGATCGCCATTCAGCTAGGGCAAGACCCCAGTGCTTATCCCATCTTTGTCTGTC

AGGCTGATGATGAACCGAACTGGCTTCTAGCTAAAACCGTTGTTCAGATTGCTGATGCCAATTACCACGAACT

GATTAGCCATTTAGGTAGAACCCATTTATTTATCGAACCCTTTGCGATCGCAACTAATCGCCAACTTGCCAGCA

ATCATCCTTTGTATATTCTGCTCAAGCCTCACTTTCAAGGAACTTTAGCGATCAATAATGCCGCTCAATCGGGAC

TGATTAGTGCTGGTGGAACCGTAGATAGTCTATTAGCGGGAACGATCGCGTCCTCGCGCACCCTTTCGGTACA

GTCAGTTAAGAACTATAACTTCAATGAAGCGATGTTGCCTGTAGCCCTGAAGAAGAGAGGGGTTGACGATGT

TAATATGCTGCCCGATTATCCCTATCGCGATGATGCTTTATTGGTCTGGGGAGCGATCGCGACTTGGGTCAAA

AATTATCTATCCATCTATTATTTCAGCGATACCGATGTCCTTAGAGATTCTGAACTGCAAGCATGGGCAAAGGA

AATTACCTCGGTTGATGGTGGGCGCGTCACAAGTTTTGGTCAAGATGGTCAGATTCAGACCTTCGATTATTTA

GTCGATGCAGTGACATTGCTGATCTTTACCAGCAGCGCTCAACATGCGGCGGTAAACTTCCCTCAGGGAGATT

TGATGGACTACACGCCAGCAATTCCGCTAGCGGGCTATACTCCCGCACCAAAGTCAACCACTGGTGCAACGGA

AGCAGATTTCTTTGCCATGCTACCGCCCATCGACCAAGCTAAGAGTCAATTGACAATGACCTATATTCTGGGAT

CTGTTTATTACACGACCCTAGGCGACTATGGTTCAGATTATTTCAACGACGATCGCCTTCAGCAACCCTTACGC

GATTTTCAAGATGGGTTAAAAGCGATCGAGTCTACAATTAAGTCGCGCAATGAGACTAGGGTTGCTGATTACA

ATTACTTAAAACCATCGCGGATTCCTCAAAGCATTAATATCTAA

Amino acid Sequence for WP_009629598.1

SEQ ID NO: 184

MISSILRGIAQILNFLATKLSDLASLILRRSPSSKYPLLPQNDPEIDQRQALLNQSRQLYQYNYTYVAPLPMVEKVPTSE

QFSLSWGLLVGKAAIEVLLNDIANPFLLSEKGKNASKAREQDFSKRLLEAGIAQSNSAIIGLLSEIPSLLETEPTNVEGS

NIKEYNDLFWIISLPTISQSFTTNSEFARLRVAGFNPVTIQRIKTLDAKFPLTEDQFQTVLAGDSLAEAGAQGRLYLAD

YVDLTAIAGGTFPKGAQKYINAPLALFAVPKGQQSLTPIAIQLGQDPSAYPIFVCQADDEPNWLLAKTVVQIADANY

HELISHLGRTHLFIEPFAIATNRQLASNHPLYILLKPHFQGTLAINNAAQSGLISAGGTVDSLLAGTIASSRTLSVQSVK

NYNFNEAMLPVALKKRGVDDVNMLPDYPYRDDALLVWGAIATWVKNYLSIYYFSDTDVLRDSELQAWAKEITSV

DGGRVTSFGQDGQIQTFDYLVDAVTLLIFTSSAQHAAVNFPQGDLMDYTPAIPLAGYTPAPKSTTGATEADFFAML

PPIDQAKSQLTMTYILGSVYYTTLGDYGSDYFNDDRLQQPLRDFQDGLKAIESTIKSRNETRVADYNYLKPSRIPQSI

NI

-continued

Coding sequence for WP_015133151.1

SEQ ID NO: 185

ATGACCGCGACCTCCCCATCTAGTAGCCAAAACCTCAGCGACAAACAGGAAAAATACCAATACAACTATCGGT

ATATGCCCCCATTGGCGATGGTCGACAGCCTGCCTGAAGAAGAGCAATGGTCTACCTCTTGGAAAATGACGGT

GGGTAAAGTTGGCTTCCAGCTCCTTGTCAACAAAATCATTTTGAATTATGGCGATCAAGGAGAAGCAGGGGC

AGCAGACGACGTTCGCGCTTTTTTGATTAGTACCTTTAAACAAACCCTCGCCGAACAAAAAGGCTTTTCAAAAG

TGGGGATTCTCCTGCAAGGCGCCAAATTTTTACCCAGATTAATTTGGGGCAAGATCACCACACAAATCGTCGA

TGTCGAAGATTTGATGAAAGAGATGATCGAAAGCATGAGTCGCAAATTTTTAGAGGACTTTGCGGCCAATGTT

ATGCAAAAGTTGACCGAAGATGCCCCCAAAGGTCGCTTTTCATCAATCAAAGAATTTGAAACGCTATTCACAG

AAATCGATCTGCCCGATATTGCCTACACCTATCAGGAAGACGAAACCTTCGCCTATATGCGCGTTGCTGGACC

GAATGCTGTAATGCTCCAGAAAATCACCGAGCCAGATCCCCGTTTCCCAGTCACAGAAGCCCATTACCAAGCG

GTTATGGGAGAAGAAGATTCTTTAGCCGCAGCACGCTCAGAAGGTCGTTTATATTTGTGCGACTATGCCATCC

TCGATGGGGCAATAGAGGGAGATTTTCCTGTGGCTCAGAAATATCTCTATGCACCATTAGCACTCTTCGCTGT

GCCCAAAGCTGATGCAGTCAAACGAAATTTAATGCCTGTAGCCATTCAGTTAGGTCAAGTCCCTAAACAAAAC

CCTATTCTGACTCCCAAATCTAATAAATATGCATGGCTCTGTGCGAAAACGGCAGTGCAGATTGCTGATGCCA

ATTTCCATGAAGCGGTCACCCATCTAGCTCGCACCCACTTGTTTATGGGGCCCTTTGCGATCGCCACCCATCGA

CAACTACCAGAGAGCCATCCCCTCTTTAAACTACTTAAACCTCATTTTTTTGGGATGCTGGCCATTAACGACTCA

GCCCAAGCTAAACTCATTGCGAAAGGCGGTGGCGTCAATAAAATCCTCTCTGCCACTATCGATAACGCCCGTT

TATTCGCCATCTTGGGCGTACAAACCTATGGCTTTAACAGTGCCATGCTACGCAAACAATTGGCAGCCAGAGG

CGTTGATGATACTGAGGGATTACCTATTTATCCGTATCGTGACGATGCTCTATTAATTTGGGATGCCATTAATA

ATTGGGTGCAAAGTTATCTCAAAACCTACTATGCGAATGATGCAGCAGTGCGGAGAGATCAGGCGATCCAAG

CTTGGGTAAAAGAATTAATCTCCGAAGATGGCGGTCGTGTGGTGGAATTTGGGGAAGATGGTGGCATCCAAA

CTCTTGAGTATCTTATCGAAGCAGTGACACTCATCATTTTTACGGTGAGCGCGCAACATGCAGCAGTAAATTTC

CCTCAAAAAAATCTTATGAGCTTCGCCCCTGGTATGCCCACAGCAGGTTACTCACCCCTTGATAATCTCGGGGA

ACACACCACAGAGCAAGACTATCTCGATTTATTACCACCGATGTCCCAAGCTCAGGAACAGCTCAAACTCTGTC

ACTTATTAGGTTCTGCACATTTTACTGAGCTTGGTCAATATGATGCCAAGCATTTCACCGACTTCAAGATTCAA

GGGGCACTCAAACAATTCCAAGCACGCCTAAAAGAGATTGAAGGTATTATTCACAAACGCAATCGTGATCGCC

CTGAATACGAATACCTTTTACCATCGCTAATTCCCCAAAGTATCAATATCTAG

Amino acid Sequence for WP_015133151.1

SEQ ID NO: 186

MTATSPSSSQNLSDKQEKYQYNYRYMPPLAMVDSLPEEEQWSTSWKMTVGKVGFQLLVNKIILNYGDQGEAGA

ADDVRAFLISTFKQTLAEQKGFSKVGILLQGAKFLPRLIWGKITTQIVDVEDLMKEMIESMSRKFLEDFAANVMQKL

TEDAPKGRFSSIKEFETLFTEIDLPDIAYTYQEDETFAYMRVAGPNAVMLQKITEPDPRFPVTEAHYQAVMGEEDSL

AAARSEGRLYLCDYAILDGAIEGDFPVAQKYLYAPLALFAVPKADAVKRNLMPVAIQLGQVPKQNPILTPKSNKYA

WLCAKTAVQIADANFHEAVTHLARTHLFMGPFAIATHRQLPESHPLFKLLKPHFFGMLAINDSAQAKLIAKGGGVN

KILSATIDNARLFAILGVQTYGFNSAMLRKQLAARGVDDTEGLPIYPYRDDALLIWDAINNWVQSYLKTYYANDAA

VRRDQAIQAWVKELISEDGGRVVEFGEDGGIQTLEYLIEAVTLIIFTVSAQHAAVNFPQKNLMSFAPGMPTAGYSP

LDNLGEHTTEQDYLDLLPPMSQAQEQLKLCHLLGSAHFTELGQYDAKHFTDFKIQGALKQFQARLKEIEGIIHKRNR

DRPEYEYLLPSLIPQSINI

Coding sequence for WP_063872765.1

SEQ ID NO: 187

ATGACTACTTCATCACCAGATAATTCCCGCAGTCTCCCCATCACCCAGAATTTGGAATTAGCGAGGCAGGAATA

TCAATATAACTATACCCATATTCCACCTATTCCTATGGTGAATCAGCTTCCTAATCAGGAAAACTTCACTACTAG

ATGGACTTTTTTATTAGCCCAGCAGTTACGGGAGATTTTCATTAATACTCTGATCACTAACCGAGGCGATCGCA

-continued

GTTCCAAATCGGTTCGTGATCAAGTCAAAAGGTTTATTTTAGAAGCCTTGTTCAAGGGGGCTATACCAGCCAA

AGTAAGTGTGATTGCGAGACTTTTCCAAATTATTCCCCAGTTTCTCATTCAAGGAATATCTAAAGATTTTCACGA

ACTAGATGATCTGTTTTTTTCCCTTTTCAAAACCAACGGACTGTTAATATTCAGAGATTCTCTGAATCGAATTAC

AGCCCTTTTAGATAAAGGCCATCCCACAGGTCATGTGAATAGTTTAAAGGACTACCAAAAGTTATTTACCACAA

TTGAATTACCAGCGATCGCCAAAACTTTCGATCAAGATCAAGTCTTTGCCTATATGCAAGTCGCCGGCTACAAT

CCCCTAGTCATCAAGCGGGTAAATAGTCCAGGCGCTAACTTCCCAGTTGAAGAGACACATTACCAAGCAGTCA

TGGGGAGCGATGATTCATTAGCAGCCGCAGGACAAGAAGGAAGGCTATACCTAGCAGACTATCAAATTTTAG

ACGGTGCTATCAACGGTACATATCTAAATTACCAAAAGTATGCCTATGCTCCCCTAGCGCTGTTTGCCATCCCC

AAAAACTCAGACCCCAATCGTCTCCTGCGCCCCATAGCTATTCAATGTGGTCAAACTCCTGGAGCCGATTATCC

CATAATTACCCCCAATTCCGGCAAATACGCCTGGCTATTTGCCAAAACCATTGTCCACATAGCCGATGGCAACT

TTCATGAAGCCGTCAGTCACCTCGCCCGAACGCACCTATTCGTTGGTGTCTTTGTCATCGCCACCCATCGGCAA

TTGTCCCCCAGCCATCCCCTCAGCCTCCTACTGCGTCCCCATTTTGAAGGCACTTTAGCAATTAACAATGCCGCC

CAAGAAGTTTTGATTGCTCCTGGCGGCGGAGTTGATAGGTTACTCTCATCGACCATTGATAACTCACGGATTTT

AGCAGTGCGCGGTTTGCAAAGCTATAGTTTCAATGAAGCTATGTTGCCAAACCAACTCAAACAAAGAGGTGTT

GATGATCCTGAACTACTGCCTGTTTATCCTTACCGGGACGATGCACTACTAATTTGGAACGCCATTCATCAATG

GGTTTCCGACTACCTGAGCCTTTATTACCCTACAGATAAAGATATTCAAAATGATACTGCTTTGCAAGCATGGG

CAGCCGAAGCCAAAGCTGAGAATGGTGGACGTGTACCTGATTTTGGTGAAAATGGAGGTATTCAGACACTAG

ACTACCTAGTTGATGCTGCTACCCTGATTATTTTTACAGCCAGCGCCCAACACGCGGCGGTTAACTTCCCCCAA

AAAGATTTGATGAGTTATGCCCCAGCTTTTCCCTTAGCAGGATATGTATCCGCCTCCATCAAGGGAGAAGTTA

GTGAACAAGACTACCTGAATTTACTCCCACCTTTGGAGCAAGCGCAACAGCAATTTAACTTGCTCACTTTACTA

GGGTCTATATATTACAACCAGCTTGGTGAATATCCAAAATCACACTTTGCTAACCCCAAGGTACAAACCTTGTT

ACAGAAGTTCCAAAGCCAACTCCAGCAAATTGAAATTACGATCAATCAGCGCAATTTGCACCGCCCAACTTAC

GAATATCTACTTCCTTCTAAAATCCCTCAGAGCATTAATATTTGA

Amino acid Sequence for WP_063872765.1

SEQ ID NO: 188

MTTSSPDNSRSLPITQNLELARQEYQYNYTHIPPIPMVNQLPNQENFTTRWTFLLAQQLREIFINTLITNRGDRSSKS

VRDQVKRFILEALFKGAIPAKVSVIARLFQIIPQFLIQGISKDFHELDDLFFSLFKTNGLLIFRDSLNRITALLDKGHPTGH

VNSLKDYQKLFTTIELPAIAKTFDQDQVFAYMQVAGYNPLVIKRVNSPGANFPVEETHYQAVMGSDDSLAAAGQE

GRLYLADYQILDGAINGTYLNYQKYAYAPLALFAIPKNSDPNRLLRPIAIQCGQTPGADYPIITPNSGKYAWLFAKTIV

HIADGNFHEAVSHLARTHLFVGVFVIATHRQLSPSHPLSLLLRPHFEGTLAINNAAQEVLIAPGGGVDRLLSSTIDNS

RILAVRGLQSYSFNEAMLPNQLKQRGVDDPELLPVYPYRDDALLIWNAIHQWVSDYLSLYYPTDKDIQNDTALQA

WAAEAKAENGGRVPDFGENGGIQTLDYLVDAATLIIFTASAQHAAVNFPQKDLMSYAPAFPLAGYVSASIKGEVSE

QDYLNLLPPLEQAQQQFNLLTLLGSIYYNQLGEYPKSHFANPKVQTLLQKFQSQLQQIEITINQRNLHRPTYEYLLPS

KIPQSINI

Coding sequence for WP_096687527.1

SEQ ID NO: 189

ATGAGATCACCAACTCCAAAACAACGACGACAAGAGTTAATTGAGCAGTATGTATTATCGCGCCGTACCATGA

TGGCGCTGATGGCCTTCGCTTGTACTCCTGGTTTGGAAACTTTACTAGTCGGTGACAATAAATCCTCAAAACCT

AAGCAATTGGATAATCCGAATGGTTGTACTCCCGGTTTGGAAACTTTACTATCTAATGACAATAAACCCTCAAA

ACCTAAGCCACCAAATAATCCTAGCATCCCAAGCTTACCTCAAAATGATACAAAAGCGACTCAACAAGAACGC

CTGACGCAGTTGGGAAAGACTCGTGAAGAATATCAGTTGGGGTTGCGGTTGCCTAATTCTGCTCGCGTGAAG

ACTTTACCCGCGACTGAATTATTTTCTGAAGGATACGAGAAGAACCGAGTAATCTTATCGCAGAAGATAGGAG

-continued

CCAATCAACAAGCGTTTTTACAAAACCCCAAACCTTTTCAAAGCTTCGATGATTACAGCGCGCTGTTTCCCGTTT

TGCCGCTACCCGATATCGCTAAAACATTCCGTAATGATTCGGTATTCGCACGACAGAGGCTTTCTGGCTGTAAC

CCGATGGAACTAAAGAACGTTCTAGCACTTGATTATAATCTTCGTAGCAAACTCGCCATAACAGATGAAATTTT

TCAAGCTGTGCTAAATGCGACAAGAACCAGAGAGCGCATTAATAAGACTCTCAACAGCGCTATTCGAGAAGG

CAGCTTATTTGTTACCGATTATGCAATACTTGATAGCATTCAGCCGAAAGAAAAGCAATTTGTTTGTGCCCCCA

TTGCACTCTATTATGCCCAAAGAATTCGTGGCGATTTTCAGCTAATCCCCATTGCTATCCAGTTAGGACAGGCG

CCGGGTTCAAGTTTACTTTGCACACCAAATGATGGAGTAGATTGGACTTTAGCCAAGTTAATAACCCAAATGG

CTGATTTCTACGTCAATCAGTTATATCGGCACTTGGGACAGACTCATCTAGTAATGGAGCCAATTGCTTTAGCA

ACAGCGCGCGAACTAGCTGCGAAGCATCCCGTAAACGTACTCTTAAAGCCTCACTTTGAGTTTACAATGGCAA

TTAATAGCCTTGGTGATGAAGTGCTAATTAATCCGGGCGGAGCAGTAGATATTATATTACCGGGTACTTTAGA

AAGCTCGCTAAAACTTACCGATACAGGTGTAGCTGACTTTTTCAACAACTTTAGCAGCTTTGCACTTCCTACTAA

TTTACGTCAGCGCGGTGTTGATAATCCTTATACCTTACCAGATTTTCCTTATCGAGACGACGGGTTGCTCGTTT

GGAATGCTTTAGAAGACTATGTAAGTAAATATATCGGTATTTACTATAAATCTAACCGAGATATCCGCGAGGA

TTTCGAGCTACAAAATTGGTTCCAAGTTTTACGGAAACCAAAGAGCGAAGGTGGTTTTGGTATAGTTTCATTAC

CAGCAAACCTGACAAACCGCGACCAATTGATAGACATTTTGACAATAATTATTTTCACTGCTGGTCCCCAACAC

TCAGCCATTGCTTGGACTCAATATCAATATATGGCTTTTATTCCTAATATGCCTGGAGCTATTTATCAGCCTATT

CCTACAACTAAAGGGAAATTCGCTGACGAAAACAGCCTTACTAGTTTCCTACCTGGAATCAAACCAAGCCTTAC

CCAAGTTCAGTTTATGTCGTTAGTCGGTACCAAGCGCGACCCAAAAGCATTTACTGATTTTGGTGTGAACAGTT

TTCAAGACCCGCAAGCCATTAGAGTTCTTAGAGATTTCCAAAATCGTTTAGAATCAATAGAAAAACGGATTGA

AGCACAAAATCAACGTCGCGAAGAATGCTACCCGGCGTTTCTTCCCTCTCGGATGTCTAATAGCGTAAGTGGT

TGA

Amino acid Sequence for WP_096687527.1

SEQ ID NO: 190

MRSPTPKQRRQELIEQYVLSRRTMMALMAFACTPGLETLLVGDNKSSKPKQLDNPNGCTPGLETLLSNDNKPSKP

KPPNNPSIPSLPQNDTKATQQERLTQLGKTREEYQLGLRLPNSARVKTLPATELFSEGYEKNRVILSQKIGANQQAFL

QNPKPFQSFDDYSALFPVLPLPDIAKTFRNDSVFARQRLSGCNPMELKNVLALDYNLRSKLAITDEIFQAVLNATRTR

ERINKTLNSAIREGSLFVTDYAILDSIQPKEKQFVCAPIALYYAQRIRGDFQLIPIAIQLGQAPGSSLLCTPNDGVDWTL

AKLITQMADFYVNQLYRHLGQTHLVMEPIALATARELAAKHPVNVLLKPHFEFTMAINSLGDEVLINPGGAVDIILP

GTLESSLKLTDTGVADFFNNFSSFALPTNLRQRGVDNPYTLPDFPYRDDGLLVWNALEDYVSKYIGIYYKSNRDIRED

FELQNWFQVLRKPKSEGGFGIVSLPANLTNRDQLIDILTIIIFTAGPQHSAIAWTQYQYMAFIPNMPGAIYQPIPTTK

GKFADENSLTSFLPGIKPSLTQVQFMSLVGTKRDPKAFTDFGVNSFQDPQAIRVLRDFQNRLESIEKRIEAQNQRRE

ECYPAFLPSRMSNSVSG

Coding sequence for WP_015138267.1

SEQ ID NO: 191

ATGAATGTGGCATCAGCAGATAATTCGAGAAGTTCCCCCAGCAACCACAACTTGGATATAGCTAGGCAGCAAT

ATCAATATAACTACACCCATATTCCCCCTTTGGCGATGGTGAATCAACTGCCACCTGCGGAAGAGTTCACCACT

CGTTGGTATTGTTTATTAGCTAAAGAATTACGCCTGATTTTTATCAATACCCTGATTGTCAACCGGGGTAATCG

TGGTTTTAAGTCGGTGAAAGATGATGTCATTGCGTTTCTTTTAGAAGCTTTGATTAAGGGAGCCATCCCATTTC

GCCTGGGTGTAATTGCCAGACTGCTGCAAATTCTCCCCCAATTTCTGCTGCGTAGCGTCTCTAAAGATTTGCGG

GAACTGGATGATCTGTTTTTATCACTACTTAAGGAAATTGGACTGTCAATTTTTACAGATTCACTCAACCGCATC

ACTAAGCTGTTATTTGAGAAACAACCCAAAGGACGCGTAACCAGTCTCAAGGATTACGAAAAATTGCTACCAG

TGTTGGGATTGCCCAAGATTGCCAGCACTTATCAAGAAGATGAAGTTTTTGCTTATATGCAAGTGGCTGGTTAT

AATCCCTTAATGATTAAGCGGGTAACTAGCCCAGGCGATCGCTTCCCAGTCACAGACGAGCATTACCAAGCCG

-continued

TGATGGGTAGTGATGATTCCTTAGCAGCAGCCGGGGAAGACGGTAGACTTTATCTGGCAGACTATGGGATTT

TAGATGGTGCGATCAATGGTACACACCCAAAACTACAAAAGTATGTCTACGCACCTCTGGCACTGTTTGCTGT

ACCCAAAGGCGCAGATGCTCACCGTTTACTCCGCCCAGTAGCCATTCAATGTGGACAAACCCCAGACGCAGAT

CACCCCATCATTACCCCTAACTCTGGTAAATACGCCTGGCTGTTTGCCAAAACTATTGTCCTCATCGCCGATGCC

AACTTTCACGAAGCCGTCAGCCACCTAGCTAGAACACACCTGTTTGTGGGTGTATTCGTGATGGCAACCCATC

GGCAACTCCCAAGCAATCATCCCCTCAGCCTGTTGTTACGCCCCCATTTCGAGGGTACATTAGCCATCAATAAT

GCCGCCCAAGAGAACCTCATCGCTCGTGATGGAGGTGTTGATCTATTACTTTCATCAACTATTGATAACTCTCG

TATTTTAGCCGTGCGTGGATTGCAAAGCTATAACTTCAACGCAGCCATGTTACCCAAGCAACTCAAACAGCGT

GGTGTGGATGATCCCAACCTATTACCTGTTTATCCTTACCGAGATGATGCCCTGTTAATCTGGGATGCTATCCG

TGATTGGGTGTCAGACTACCTCAAGCTTTACTATCCTACAGATGCAGATGTGGAAAAAGACGCAGCCTTACAA

GCATGGGCAACCGAAGCCCAAGCTTACGAAGGTGGTAGAATTACTGGCTTTGGTGAAGATGGAGGTATCAAA

ACCAGAGAATATCTAATTGATGCGGTAACACTGATCATTTTCACCGCCAGTGTTCAACACGCGGCGGTAAACT

TTCCCCAGAAAGATATCATGGGCTATGCCCCAGTTGTCCCACTAGCCGGTTATATGCCAGCCTCAACCCTCAAG

GGAGAAGTGACTGAGCAAGACTACCTCAACTTGCTGCCTCCACTAGAACAAGCACAAGGGCAATATAACTTAC

TTTACTTATTAGGATCTGTGTATTACAACAAACTCGGTCAATATCCACAACCACACTTTACTGATCCACAAGTAA

CATCCTTATTGCAAAGCTTCCAAGATAAACTCCAGCTAATTGAAGACACCATCAATCAGCGCAATTTAAACCGC

CCAGCCTATGAATATTTGCTCCCTTCCAAGATTCCCCAGAGTATTAATATTTAA

Amino acid Sequence for WP_015138267.1

SEQ ID NO: 192

MNVASADNSRSSPSNHNLDIARQQYQYNYTHIPPLAMVNQLPPAEEFTTRWYCLLAKELRLIFINTLIVNRGNRGF

KSVKDDVIAFLLEALIKGAIPFRLGVIARLLQILPQFLLRSVSKDLRELDDLFLSLLKEIGLSIFTDSLNRITKLLFEKQPKGR

VTSLKDYEKLLPVLGLPKIASTYQEDEVFAYMQVAGYNPLMIKRVTSPGDRFPVTDEHYQAVMGSDDSLAAAGED

GRLYLADYGILDGAINGTHPKLQKYVYAPLALFAVPKGADAHRLLRPVAIQCGQTPDADHPIITPNSGKYAWLFAKT

IVLIADANFHEAVSHLARTHLFVGVFVMATHRQLPSNHPLSLLLRPHFEGTLAINNAAQENLIARDGGVDLLLSSTID

NSRILAVRGLQSYNFNAAMLPKQLKQRGVDDPNLLPVYPYRDDALLIWDAIRDWVSDYLKLYYPTDADVEKDAAL

QAWATEAQAYEGGRITGFGEDGGIKTREYLIDAVTLIIFTASVQHAAVNFPQKDIMGYAPVVPLAGYMPASTLKGE

VTEQDYLNLLPPLEQAQGQYNLLYLLGSVYYNKLGQYPQPHFTDPQVTSLLQSFQDKLQLIEDTINQRNLNRPAYEY

LLPSKIPQSINI

Coding sequence for WP_094347473.1

SEQ ID NO: 193

ATGACTGCTTCATCACCAGAAAATTCAATCAGCTTATCAAGTACTCATACTTTAGATATAGCTAGGCAAGAGTA

TCAATATAACTACACCCATATTCCATCTATTGCGATGCTAGATCGGCTTTCTATTGCCGAAGAGTTCGCTACTAA

CTGGTATTTTTTATTAGCCCAGCAGTTACGAGTTGTGTTTATTAATACCTTGATTGTCAACAGAGGCAATCAAG

GTTCTAAATCGATTCGTGATGATGTCGAAAGGTTTATTTTAGAAGCCTTTCTCAAGGGAGCAGTACCAGTAAA

AATCACTATTCTGGCAAGAATCCTGCAAATTATCCCTCAGTTTTTGCTCAATGGCATCTCTAAGGATGTTAGAG

AACTCGACGATCTTTTTTATTCTATTCTGAAAGAAAACGGACTTGTGATCCTCAGAGATGCTCTAAATAGGATA

ATTAACCTTCTATACGAAGGACAGCCTACAGGACATGCAACCAGTCTTAAGGACTACGAAAATTTGTTTCCGG

TGATTGGTGTGCCAGGAATCGCTAAAACTTACCAAGAAGATGAAGTATTTGCCTATATGCGAGTGGCTGGCTA

CAATCCCGTCACGATCGCGCGAGTAACGACTCCAGGCGATCGCTTCCCAGTCATAGACGAACATTACCAAGGA

GTGATGGGAACTGACGATTCATTAGCAGCAGCCGGACTTGAAGGCAGACTCTACTTAGCTGACTATAAAATTT

TAGATGGTGCGGTCAACGGTACATTCCCACACGAGCAAAAATATCTCTATGCTCCCCTAGCACTATTTGCCTTA

CCCAAAGGCTCAGACCCCACCCGTTTATTGCGTCCAATAGCCATTCAATGCGGTCAAACCCCAGACCCAGATTA

-continued

TCCAATTGTTACCCCTAACTCCGGTAAATACTCTTGGCTTTTTGCCAAAACAGTAGTCCAAATAGCAGATGCAA

ACTACCACGAAGCTGTTACTCATCTAGCAAGAACTCACCTGTTTGTTGGTGTTTTTGCGATCGCCACCGCTCGA

CAATTGCCACTCACCCATCCCCTAAGAATTCTCCTGCACCCGCATTTTGACAGCACTTTAGCAATTAACGATGCC

GCCCAACGTATTCTCATAGCTCCAGGCGGTGGTGTCGATAGATTACTCTCATCATCAATCGATAACTCTCGCGT

TTTAGTAGTGCTAGGGTTGCAAAGCTATGGTTTTAATAGCGCCATCTTACCTAAGCAATTCCAACAGCGCGGT

GTAGACGATCCCAACCTCTTGCCTGTTTATCCTTACCGGGATGATGCGCTACTAGTCTGGGATGCCATTCATCA

ATGGGTTGCAGACTACCTAAATCTTTACTACACCACCGATGAAGACATTCAAAAAGACACAGCATTGCAAGCC

TGGGCAGCCGAAATCTCAGCTTACGATGGTGGTCGCATCCCCGATTTTGGCGAAGATGGGGGCATCAAAACG

CGCAATTACCTGATTGATGCCACTACGCTGATTATTTTCACTGCCAGCGCTCAACACGCTGCGGTTAACTTTCC

GCAAAAAGATTTTATGAGCTACGCCGCAGCGATTCCAATGGCAGGTTATTTACCAGCCTCAACTCTCAAAAGA

GAAGTTACTGAGCAAGACTACCTTAATTTGCTCCCTCCCTTAGATCAGGCGCAACGGCAATACAACCTACTCAG

CTTATTGGGATCTGTGTATTACAACAAGCTGGGTGATTATCAGCAAGGATACTTTACAGACCAGAAAGTAAAA

CCATTGCTACAAGCATTCCAAAGTAATCTTCAGCAGGTAGAAGATACCATCAAGCAACGTAATTTGCACCGTCC

ACCCTATGAGTATCTACTTCCTTCTAAAATTCCTCAGAGCATCAATATCTAG

Amino acid Sequence for WP_094347473.1

SEQ ID NO: 194

MTASSPENSISLSSTHTLDIARQEYQYNYTHIPSIAMLDRLSIAEEFATNWYFLLAQQLRVVFINTLIVNRGNQGSKSI

RDDVERFILEAFLKGAVPVKITILARILQIIPQFLLNGISKDVRELDDLFYSILKENGLVILRDALNRIINLLYEGQPTGHAT

SLKDYENLFPVIGVPGIAKTYQEDEVFAYMRVAGYNPVTIARVTTPGDRFPVIDEHYQGVMGTDDSLAAAGLEGRL

YLADYKILDGAVNGTFPHEQKYLYAPLALFALPKGSDPTRLLRPIAIQCGQTPDPDYPIVTPNSGKYSWLFAKTVVQI

ADANYHEAVTHLARTHLFVGVFAIATARQLPLTHPLRILLHPHFDSTLAINDAAQRILIAPGGGVDRLLSSSIDNSRVL

VVLGLQSYGFNSAILPKQFQQRGVDDPNLLPVYPYRDDALLVWDAIHQWVADYLNLYYTTDEDIQKDTALQAWA

AEISAYDGGRIPDFGEDGGIKTRNYLIDATTLIIFTASAQHAAVNFPQKDFMSYAAAIPMAGYLPASTLKREVTEQDY

LNLLPPLDQAQRQYNLLSLLGSVYYNKLGDYQQGYFTDQKVKPLLQAFQSNLQQVEDTIKQRNLHRPPYEYLLPSKI

PQSINI

Coding sequence for WP_012164252.1

SEQ ID NO: 195

ATGACGCCACAATATGAATATCGATACGATGCCCTGAAAGACGTTTCCCCTGAATTGAAATATCCAATGGCCA

AGGAGGTGTTTCCAGCAGACCAATCTTTGACAAAATGGCCCTGGACTCGAGACCTCGTTTCCGTTGTACTCAG

AATTATTGCCAATCAGGCCATGCAGGATATATCCGTCCGCCGAGGATCAGCCTGTCGTCTGATTACGTTTATCC

GCTTGTATCGAATTCTAGAAAATCCCCTCTATCAGTCAGGTCTGGAGCGGGTTTTCAATGCTATCAATAATCTC

GTACGGGGTCTCTCCAATATTTTTGGCAACAGAGCCCAGTCTCAAAATATCAAGCATGATGTAAAGGACGAGC

AACATCCTGAAAAAGTCTCCGCCCGCATTTCCGCCATAGCCAAGGATATCCAAGAAACGGCTGAGTCGAGAGA

GGCAAGAGAGCAAACTTCTTTAGCTGACTATCGCGATCTCTTTCAGATCATTTACTTACCGGACATTAGCAACC

ATTTCCTAGAAGATCGTGCCTTTGCCGCTCAACGGGTTGCCGGAGCCAACCCCCTCGTGATTAACCGCATTTCT

GAACTCCCAGACCATTTCCAAGTCACTGACCAACAGTTTAAAGCTGTGATGGGAGATAGTGAGTCCCTCCAAG

CAGCTTTGAATGATGGCCGAGTCTATCTGGCAGACTATCAAATTCTAGAAGAAATTGATGCGGGTACTGTTGA

GGTAAAGGATCGCGAAATTCCAAAGTATAGATATGCGCCGTTGGCCTTATTTGCGATCGCATCCGGAAATTGT

CCCGGTCGCCTCCTCCAACCGATTGCCATTCAATGCCACCAAGAAGCAGGCAGCCCGATATTTACACCACCCA

GTCTAGAAGCCGATAAAGAGGAGCGGCTCGCTTGGCGCATGGCCAAGACCGTCGTTCAAATCGCCGATGGTA

ACTACCATGAATTGATTTCTCATTTAGGGCGGACTCATCTCTGGATTGAGCCCATTGCTTTAGGCACTTACCGA

CGCCTAGGAACAGAGCATCCACTGGGTAAATTGCTCCTCCCCCACTTCGAAGGCACCTTATTTATCAACAATGC

GGCAGCCAATAGCTTAATTGCTCCAGGTGGCACCGTAGACAAAATCTTATTTGGCACCTTAAAGTCATCTGTTC

-continued

AGCTCAGCGTCAAAGGCGCTAAGGGTTACCCCTTTTCTTTCAATGACTCCATGCTCCCCCAAACCTTTGCATCG

CGAGGCGTGGACGACCTACAAAAGCTACCGGACTACCCGTATCGAGATGATGCATTACTGATTTGGCACGCC

ATTCACGATTGGGTTGAGGCCTATCTTCAGATCTACTACAAAGATGATGATGCAGTCCTCAAGGATGACATCCT

CCAGGATTGGTTAGCCGAGCTACGAGCTGAAGATGGAGGCCAGATGACTGAAATCGGTGAATCAACTCCAGA

AGAACCCGAGCCTAAAATTCGCACCTTGGATTACCTCATTAATGCGACAACGCTCATTATTTTTACCTGCAGTG

CCCAACATGCATCTGTCAACTTCCCTCAAGCATCATTGATGACGTTCGTCCCCAATATGCCCCTAGCAGGGTTC

AATGAAGGTCCGACGGCAGAGAAAGCCAGTGAAGCAGATTATTTCTCTTTACTACCACCCCTGAGTTTGGCCG

AACAACAGTTGGATCTAGGGTATACCTTGGGTTCGGTCTACTATACTCAGCTCGGATATTACAAAGCCAATGA

TGTGGATTTAGATGATATTAACGACCATACCTACTTCAAGGACCTCCAAGTTAAACAGGCCCTCCGAGACTTCC

AACAAAGATTAGAAGAAATTGAGTTGATCATTCAAGACCGGAACGAAACCCGACCCACTTATTACGACATCTT

GCTCCCATCCAAGATTCCCCAAAGTACCAACATTTAA

Amino acid Sequence for WP_012164252.1

SEQ ID NO: 196

MTPQYEYRYDALKDVSPELKYPMAKEVFPADQSLTKWPWTRDLVSVVLRIIANQAMQDISVRRGSACRLITFIRLY

RILENPLYQSGLERVFNAINNLVRGLSNIFGNRAQSQNIKHDVKDEQHPEKVSARISAIAKDIQETAESREAREQTSL

ADYRDLFQIIYLPDISNHFLEDRAFAAQRVAGANPLVINRISELPDHFQVTDQQFKAVMGDSESLQAALNDGRVYL

ADYQILEEIDAGTVEVKDREIPKYRYAPLALFAIASGNCPGRLLQPIAIQCHQEAGSPIFTPPSLEADKEERLAWRMAK

TVVQIADGNYHELISHLGRTHLWIEPIALGTYRRLGTEHPLGKLLLPHFEGTLFINNAAANSLIAPGGTVDKILFGTLKS

SVQLSVKGAKGYPFSFNDSMLPQTFASRGVDDLQKLPDYPYRDDALLIWHAIHDWVEAYLQIYYKDDDAVLKDDIL

QDWLAELRAEDGGQMTEIGESTPEEPEPKIRTLDYLINATTLIIFTCSAQHASVNFPQASLMTFVPNMPLAGFNEGP

TAEKASEADYFSLLPPLSLAEQQLDLGYTLGSVYYTQLGYYKANDVDLDDINDHTYFKDLQVKQALRDFQQRLEEIEL

IIQDRNETRPTYYDILLPSKIPQSTNI

Coding sequence for WP_015121985.1

SEQ ID NO: 197

ATGACAGATTTATCAGAAAATAATCAAAATAATTTGTCACCAGTGGATAAATTAAAACTTGCTAGGCAAGAAT

ACCAGTATAACTATAGCCATATTCCACCTATTGCAATGGTGGATCAACTTCCTAGTAATGAGAATTTCTCTACTG

GCTGGCTGCGTTTGTTAGCTAAAGAATTAAAAGTTGTTTTTATCAATACCCTAATCGCAAATCGAGGAAATCGT

GGTTCCGAAAGTGTCCGCGACGATGTGAGATTATTTCTGATAGAAGTGTTAGCTAAAGGGGCATTACCGTTTA

ATTTAACTGTTAGTGCTAGAATTTTACAAATTATTCCGAATTTATTACTTACAGGAATATCAAAGGATTATAGTG

AAATTGATGAGTTGTTCTTTTCCATACTTAGGGAAAGCGGACTTTCTATTTTTCAAGATTCTCTAAGTCGAGTTA

AAAGTCTTTTATATGAAAAACGTCCTAGGGGACATGCGAAAAGCTTAAATGATTATCACAAGCTGTTCCCCGA

GATGGGAATACCCAAGATAGCCGAGAATTTCTCTACAGACGAACAATTTGCTTATATGCGGGTAGCTGGATAC

AACCCGGTAATGATTGAGCAAGTGAATAAATTGGGCGATCGCTTTCCCGTTACCGAGGCTCAATATCGGGAA

GTCATGGGAGATGATTCTTTAGCGGCAGCAGGTGAAGAAGGAAGACTTTATTTAGCAGACTATGGAATTTTG

AAAGGTGCTGTTAACGGTACTTTTCCTTCACAGCAAAAGTATATTTACGCTCCCCTAGCACTATTTGCAATTCCT

AAAAATTCCAATAGCAATAAACCAACTTTAATGCGTCCAGTTGCGATTCAGTGCGGTCAAAATCCCCAGGATA

ATCCGATTATTACGCCTAAATCAGACAAATATGCTTGGCTGTTTGCAAAAACTATCGTGCAAATCGCAGATGCT

AACTACCACGAAGCTGTAACTCATTTAGGACGCACTCATTTACTTGTAGGTCCTTTTGTTGTTGCAACTCATCGT

CAGTTACCGGATAGTCATCCGCTTAATATATTACTAAGTCCTCATTTTGAAGGAACTTTAGCGATAAACGATGC

AGCCCAACGTCGTTTGATTGCTGCTGGTGGAGGTGTGGATAAATTACTGGCATCGACTATTGATAATTCCCGT

GTTTTGGCAGCAGTCGGTTTACAAAGCTATGGGTTTAATGAAGCCATGTTACCCAAGCAATTAGAGAAACGCG

GCGTTAACGATACACAAAAGCTACCTGTTTACCCATACCGCGATGATGCGCTGTTAGTTTGGAATACAATTCAT

-continued

CAATGGGTTGGTGACTATTTAAACATTTACTACAAAAGCGATGCGGATGTTAAAAATGACACCAAACTTCAGA
ACTGGGCTATTGAAGCAGGGGCTTTTGATGGCGGAAGAGTTCCAGATTTTGGTCAACAACATGGGCTTATTCA
AACCTTAGATTACTTAATTGATGCTATTACGCTGATTATTTTTACTGCTAGCGCTCAACATGCTGCGGTTAATTT
TCCCCAGGGAGACATGATGAACTACGCTCCAGCAGTACCCTTAGCTGGTTATCAGCCTGCTTCAATTCTTGAAG
GCAAAGTTACCGAAGAAAACTATTTAAATTTACTTCCACCTTTAGAACAAGCACAAGAACAATTAAACTTAGTC
CACTTGTTAGGTTCTATTTACTATCAAACTTTAGGTGATTACCCAGAGAATTACTTCAAAGATACCTTAGTAAAA
CCAGCTTTGCAACAATTCCGAAATAATTTAATTGAAGTTGAAGCTACTATTCATCAACGCAATCAAAATCGTCC
TACTTACGAATATTTGCTTCCTTCAAAAATTCCTCAAAGTATTAATATTTAG

Amino acid Sequence for WP_015121985.1

SEQ ID NO: 198

MTDLSENNQNNLSPVDKLKLARQEYQYNYSHIPPIAMVDQLPSNENFSTGWLRLLAKELKVVFINTLIANRGNRGS
ESVRDDVRLFLIEVLAKGALPFNLTVSARILQIIPNLLLTGISKDYSEIDELFFSILRESGLSIFQDSLSRVKSLLYEKRPRGH
AKSLNDYHKLFPEMGIPKIAENFSTDEQFAYMRVAGYNPVMIEQVNKLGDRFPVTEAQYREVMGDDSLAAAGEE
GRLYLADYGILKGAVNGTFPSQQKYIYAPLALFAIPKNSNSNKPTLMRPVAIQCGQNPQDNPIITPKSDKYAWLFAK
TIVQIADANYHEAVTHLGRTHLLVGPFVVATHRQLPDSHPLNILLSPHFEGTLAINDAAQRRLIAAGGGVDKLLASTI
DNSRVLAAVGLQSYGFNEAMLPKQLEKRGVNDTQKLPVYPYRDDALLVWNTIHQWVGDYLNIYYKSDADVKNDT
KLQNWAIEAGAFDGGRVPDFGQQHGLIQTLDYLIDAITLIIFTASAQHAAVNFPQGDMMNYAPAVPLAGYQPASI
LEGKVTEENYLNLLPPLEQAQEQLNLVHLLGSIYYQTLGDYPENYFKDTLVKPALQQFRNNLIEVEATIHQRNQNRP
TYEYLLPSKIPQSINI

Coding sequence for WP_038083060.1

SEQ ID NO: 199

ATGACTGCTTCATCACAAGATAATTCGATAAATGTCCCAAATGCAGATAATCTGGACATAGCTAGGCAAGAAT
ACCAATATAGCTACACCCATATCCCACCTCTGGCTATGGTGGATCGGCTACCTCCAGCAGAAGATTTTGCAAGT
GCCTGGTACTTTTTGTTGGCTCAGCAAGTTAGGGGACTATTTGTTAATACTCTAATTACTAACCGAGGAAATCG
CGGCTCCGAGTCGATCCGTGATGATGTGAGATTGTTTATCCTGGAAGTATTGCTGAAAGGAGCAATACCTTTC
CAAACCAACATTATTGTTAAAGTTTTACAAATTGTCCCTCAGATTTTAGCTCAAGGTATATCTCGAGATTACCGA
GAACTCGACGATCTGTTATTTTCTATCCTCAAAGACAGCGGCATCACAATTCTTAAAGATTCTTTAAACAAAGTT
ATTGAGCTTTTGTACGAAGGACAACCAACTGGACGCCCTACCAGTTTGAATGATTACGAAAAGTTATTCCCAG
TGCTGGGAGTCCCCGCGATCGCAACAACATTCCAAGACGATGAAGTGTTTGCCTATATGCGAGTTGCAGGGTA
CAATCCCGTAATCATTGAGCGAGTCAGCAGTCCTGGCGATCGTTTTCCAGTCACAGAAGAACATTACCAGGTG
GTGATGGGAACTGATGATTCCCTTGCAGCAGCCGGAGAAGAAGGAAGGCTCTACTTAACAGATTATGGAATT
TTAGAAGGAACGATCGGCGGGACATTCCCGTACTATCAAAAATACCTTTACGCTCCCTTAGCACTTTTTGCATT
ACCCAAAGGCTCTGACCCCAACCGTCTGCTGCGCCCGATAGCCATTCAATGCGGTCAAACTCCCGGTCCAGAT
TATCCGATCGTCACCCCTAACTCCGGTAAGTATGCTTGGCTGTTTGCCAAAACCGTTGTCCAGATAGCAGATGC
CAATGTCCACGAAGCTGTCACTCACCTAGCCAGAACACACTTATTCGTTGGTGCTTTTGTACTTGCAACCCATC
GCCAACTTCTCCGCACCCATCCTTTAAGCGTACTTCTGCGTCCTCATTTCGAGGGAACCTTAGCAATTAACGAT
GCAGCCCAACGAGCTTTGATTGCTCCTGGTGGTGGAGTTGATAGATTGCTTTCAGCAACCATCGATAACTCTC
GGGTTTTAGCGGTGTACGGGTTGCAAAGTTACAGTTTCAATAATGCCATCCTACCAAAGCAATTTAAGCAGCG
AGGCGTGGAAGATCCCAATCTATTGCCCGTATATCCTTACCGAGATGATGCACTTTTGGTTTGGAATGCCATTC
ATCAATGGGTTTCGAGTTACGTAAACCTTTACTACTCCACTAATGAGGACATTCAAAAAGACGCAGCCCTTCAA
GCATGGGTTGCTGAAGCCCGATCTTACGATGGCGGTCGCGTGTTTGATTTTGGTGAAGATGGAGGTATCAAG
ACACGAGAATATCTAGCAGATGCCCTTACGCTGATTATTTTCACAGCCAGCGCTCAACATGCTGCGGTTAACTT
TCCCCAGAAAAGTCTCATGGGTTACGCAGCTGCCGTACCACTAGCAGGTTACGCACCAGCCTCAACTCTCACTA

-continued

AGGAAGTGAGTGAAGAAGACTATCTCAAATTGCTCGCACCCCTAGATCAAGCACAAAGGCAGTATAATTTACT

GGCTTTGCTGAGTGCTGTTTACTATAACAAACTCGGTGAATACCCGCAAGGACACTTTACAAATCCACAAGTCC

AACCTTTACTACAGGAATTTCAGAGCAATCTCAAGCAGGTTGAAGCAACTATCAATCAGCGCAATTTGAAACG

CCCAATCTATAATTATTTGCTGCCTTCCAAAATTCCCCAGAGCATTAATATTTAG

Amino acid Sequence for WP_038083060.1

SEQ ID NO: 200

MTASSQDNSINVPNADNLDIARQEYQYSYTHIPPLAMVDRLPPAEDFASAWYFLLAQQVRGLFVNTLITNRGNRG

SESIRDDVRLFILEVLLKGAIPFQTNIIVKVLQIVPQILAQGISRDYRELDDLLFSILKDSGITILKDSLNKVIELLYEGQPTG

RPTSLNDYEKLFPVLGVPAIATTFQDDEVFAYMRVAGYNPVIIERVSSPGDRFPVTEEHYQVVMGTDDSLAAAGEE

GRLYLTDYGILEGTIGGTFPYYQKYLYAPLALFALPKGSDPNRLLRPIAIQCGQTPGPDYPIVTPNSGKYAWLFAKTVV

QIADANVHEAVTHLARTHLFVGAFVLATHRQLLRTHPLSVLLRPHFEGTLAINDAAQRALIAPGGGVDRLLSATIDN

SRVLAVYGLQSYSFNNAILPKQFKQRGVEDPNLLPVYPYRDDALLVWNAIHQWVSSYVNLYYSTNEDIQKDAALQA

WVAEARSYDGGRVFDFGEDGGIKTREYLADALTLIIFTASAQHAAVNFPQKSLMGYAAAVPLAGYAPASTLTKEVS

EEDYLKLLAPLDQAQRQYNLLALLSAVYYNKLGEYPQGHFTNPQVQPLLQEFQSNLKQVEATINQRNLKRPIYNYLL

PSKIPQSINI

Coding sequence for WP_006516541.1

SEQ ID NO: 201

ATGACTGCAAGCTATAAAAATCAAAATCTGCAAGAAAAAAAGCAGCAATATCAGTATAACTATACCCATATCC

CACCTGTGGCCATGGTAGACAAACTGTCAGAAGAGGAGGGGTTTTCTCCTGGATGGCGGTTGTTAGTGGCCA

AGGTTGGGTTTGAACTCCTCGTTAACACCATTATTGCTAATCGTGGAGATCAGGGTAAATCTGGAGCAGCCGA

TGATGTCAAAATATTTCTGATAGAAACGGTTAAGGAAACATTGGTAGATTACAAAGGTTTTTCTCGCCTGAAG

ATTCTCTGGCAAGGGGCAAAATATACCCCTAGACTCTTATTTGGCAGATTATCTATCAATGTAGAAGAGATTGA

AGATCTGATTACAGATATTATCAAAAGTGTCAGCGCTGATTTCCTCCGAGATTTTGCAGCTAACGTACAGCAAA

AATTAATACTGGACTCTCCTAAAGGTAAAGGGGATGACCTCAAAGATTTTCAGGAGCTATTTCAAACCATTGA

TCTACCTGCCATCGCTTATACCTATGAGGAGGATGAGGTATTTGCATCCATGCGGGTAGCTGGGCCTAATCCG

GTCATGCTACAGCGACTGACAGAACCTGAGGCACGGCTGCCGATCACAGAGGCTCAATATCAAGCCGTCATG

GGAGCAACGGATTCTCTGACAGAGGCCTATGCAGAGGGACGTGTATACCTGACGGATTACGCCATTCTAGAG

GGGGCAATCAATGGCTCATTTCCCGCCGATCAGAAATATCTATACGCCCCCCTAGCCCTATTTGCTGTACCGAA

AGCCGATGTGGGCGATCGTCGTCTGCGTCCGGTGGCCATTCAATGTGGGCAAAACCCTAATGATTTTCCCATC

CACACGCCCAAATCAAATCCCTATGCATGGCTCTGCGCTAAGACCATTGTGCAGGTTGCCGATGCGAACTTCC

ATGAGGCGGTTACCCATCTGGCGCGGACTCATTTGTTCATTGGGCCATTTGCGATCGCAACCCACCGCCAACTC

CCCGACAATCATCCCCTCAGTCTTCTCCTGCGCCCCCACTTCCAAGGCATGCTGGCCATCAACAACGAAGCCCA

GGCCAAGCTGATTGCTGCCGGTGGTGGCGTTAACAAAATTCTCTCAGCAACCATCGACACGTCCCGAGTATTT

GCCGTCCTGGGGGTACAAACCTATGGCTTCAATTCCGCCATGTTCCCCAAGCAGCTGCAACAGCGCGGTGTAG

ACGACACCAACAGCCTACCCATCTACCCCTACCGTGATGACGGTAGCTTAATTTGGGACGCCATCCACAATTG

GGTAGAGGACTATCTCAAGCTGTACTATGCCGATGACGCTGCAGTACAGCAAGATGCTAATTTGCAAGCCTGG

GCACAGGAACTCATTGCTTATGATGGCGGTCGCGTCATAGAGTTTGGCGAAACTGACGAACAACTGCAAACG

CTGCTGCAAACCCTTACGTATCTCATTGATGCCATTACTCTGATTATTTTTACCGCCAGTGCTCAACACGCCGCT

GTGAATTTCCCCCAAAAGGACATCATGAGCTTCACCCCAGCGATGCCGACCGCTGGCTATGATGAGTTACCAG

ATCTGGGAGACCAGACCACAAAAGAAGATTACCTGAGTTTGTTACCGCCTTTAAACCAAGCCCAAGAGCAGCT

-continued

CAAGCTATTGCACTTGCTTGGCTCCGTGCATTTTACAGAATTAGGCCAGTACGAAAAGGGACATTTTCAAGAC

AGTCAAGTACAAGCCCCCTTGCAACGTTTCCAGAATCGATTAGAAGAAATCACAGATGTGATCTACCAGCGCA

ATCGCAATCGTCCCGCCTACGAATATCTATTACCCAAGAATATTCCCCAAAGCATCAATATCTAG

Amino acid Sequence for WP_006516541.1

SEQ ID NO: 202

MTASYKNQNLQEKKQQYQYNYTHIPPVAMVDKLSEEEGFSPGWRLLVAKVGFELLVNTIIANRGDQGKSGAADD

VKIFLIETVKETLVDYKGFSRLKILWQGAKYTPRLLFGRLSINVEEIEDLITDIIKSVSADFLRDFAANVQQKLILDSPKGK

GDDLKDFQELFQTIDLPAIAYTYEEDEVFASMRVAGPNPVMLQRLTEPEARLPITEAQYQAVMGATDSLTEAYAEG

RVYLTDYAILEGAINGSFPADQKYLYAPLALFAVPKADVGDRRLRPVAIQCGQNPNDFPIHTPKSNPYAWLCAKTIV

QVADANFHEAVTHLARTHLFIGPFAIATHRQLPDNHPLSLLLRPHFQGMLAINNEAQAKLIAAGGGVNKILSATIDT

SRVFAVLGVQTYGFNSAMFPKQLQQRGVDDTNSLPIYPYRDDGSLIWDAIHNWVEDYLKLYYADDAAVQQDANL

QAWAQELIAYDGGRVIEFGETDEQLQTLLQTLTYLIDAITLIIFTASAQHAAVNFPQKDIMSFTPAMPTAGYDELPDL

GDQTTKEDYLSLLPPLNQAQEQLKLLHLLGSVHFTELGQYEKGHFQDSQVQAPLQRFQNRLEEITDVIYQRNRNRP

AYEYLLPKNIPQSINI

Coding sequence for WP_099100980.1

SEQ ID NO: 203

ATGACTGCTTCATCACCAGAAAATTCAATTAGCTCATCAAGTACTCATACTTTAGATATAGCTAGGCAAGAGTA

TCAATATAACTACACCCATATTCCATCTATTGCGATGCTAGATCGGCTTTCTATTGCCGAAGAGTTCGCTACTAA

CTGGTATTTTTTATTAGCCCAGCAGTTACGAGTTGTGTTTATTAATACTTTGATTGTCAACAGAGGCAATCAAG

GTTCTAAATCGATTCGTGATGATGTCGAAAGGTTTATTTTAGAAGCCTTTCTCAAGGGAGCAGTACCAGCAAA

AATCAGTATTTTGGCAAGAATCCTGCAAATTATCCCTCAGTTTTTGCTCAAAAGTATATCTAAGGATGTTAGAG

AACTCGACGATCTTTTTTATTCTATTCTGAAAGAAAACGGACTTGTAATCCTCAGAGATGCTCTAAATAGGATA

ATTAACCTTCTATATGAAGGACAACCTACAGGACATGCAACCAGTCTCAAGGATTATGAAAATTTGTTTCCAGT

GATTGGTATGCCAGCGATCGCTAAAACCTACCAAGAAGATGAAGTATTTGCCTACATGAGAGTCGCTGGCTAC

AATCCCGTCACGATCGCGCGAGTAACGACTCCAGGCGATCGCTTCCCAGTCACAGACGAACATTACCAAGCAG

TGATGGGAACTGACGATTCACTAGCAGCAGCCGGACTTGAAGGCAGGCTCTACTTAGCTGACTATAAAATTTT

AGATGGTGCGGTCAACGGTACATTCCCACACGAGCAAAAATATCTCTATGCTCCCCTAGCACTATTTGCCTTAC

CCAAAGGCTCAGACCCCACCCGTCTATTGCGTCCAATAGCCATTCAATGCGGTCAAACCCCAGGCCCAGATTAT

CCAATTGTTACCCCTAACTCCGGTAAATACTCTTGGCTTTTTGCCAAAACAGTAGTCCAAATAGCAGATGCAAA

CTACCACGAAGCTGTTACTCATCTAGCAAGAACTCACCTCTTGGTTGGTGTTTTTGCGATCGCCACCGCTCGAC

AATTGCCACTCACCCATCCCCTAAGAATTCTCCTGCACCCGCATTTTGACAGCACTTTAGCAATTAACGATGCCG

CCCAACGTATTCTCATAGCTCCAGGCGGTGGTGTCGATAGATTACTCTCATCATCAATCGATAACTCTCGCGTT

TTAGCAGTGCTAGGGTTGCAAAGCTATGGTTTTAACAGCGCCATCTTACCTAAGCAATTCCAACAGCGCGGTG

TAGACGATCCCAACCTCTTGCCTGTTTATCCTTACCGGGATGATGCACTATTAGTCTGGGATGCCATTCATCAAT

GGGTTTCAGACTACCTGAACCTTTACTACACCACGGATGAAGACATTCAAAAAGACACAGCATTGCAAGCGTG

GGCAGTTGAAATCTCAGCTTACGATGGTGGTCGCATCCGCGATTTTGGCGAAGATGGGAGCATCAAAACGCG

CAATTACCTAATTGATGCCACTACGCTGATTATTTTCACTGCCAGCGCTCAACACGCTGCCGTTAACTTTCCGCA

AAAAGATTTTATGGGCTACGCCGCAGCCATACCATTGGCAGGTTATTTACCAGCCTCAACTCTCAAAAGAGAA

GTTACTGAGCAAGACTACCTTAATTTGCTCCCTCCCTTAGATCAGGCGCAACGGCAATACAACCTACTCAGCTT

ATTGGGGTCTGTGTATTACAACAAGCTGGGTGATTATCAGCAAGGATACTTTACAGACCAGAAAGTAAAACCA

TTGCTACAAGCATTCCAGAGTAATCTTCAGCAGGTAGAAGATACCATCAAGCAACGTAATTTGCACCGTCCAC

CCTATGAGTATCTGCTTCCTTCTAAAATTCCTCAGAGCATCAATATCTGA

-continued

Amino acid Sequence for WP_099100980.1

SEQ ID NO: 204

MTASSPENSISSSSTHTLDIARQEYQYNYTHIPSIAMLDRLSIAEEFATNWYFLLAQQLRVVFINTLIVNRGNQGSKSI

RDDVERFILEAFLKGAVPAKISILARILQIIPQFLLKSISKDVRELDDLFYSILKENGLVILRDALNRIINLLYEGQPTGHAT

SLKDYENLFPVIGMPAIAKTYQEDEVFAYMRVAGYNPVTIARVTTPGDRFPVTDEHYQAVMGTDDSLAAAGLEGR

LYLADYKILDGAVNGTFPHEQKYLYAPLALFALPKGSDPTRLLRPIAIQCGQTPGPDYPIVTPNSGKYSWLFAKTVVQI

ADANYHEAVTHLARTHLLVGVFAIATARQLPLTHPLRILLHPHFDSTLAINDAAQRILIAPGGGVDRLLSSSIDNSRVL

AVLGLQSYGFNSAILPKQFQQRGVDDPNLLPVYPYRDDALLVWDAIHQWVSDYLNLYYTTDEDIQKDTALQAWA

VEISAYDGGRIRDFGEDGSIKTRNYLIDATTLIIFTASAQHAAVNFPQKDFMGYAAAIPLAGYLPASTLKREVTEQDYL

NLLPPLDQAQRQYNLLSLLGSVYYNKLGDYQQGYFTDQKVKPLLQAFQSNLQQVEDTIKQRNLHRPPYEYLLPSKIP

QSINI

Coding sequence for WP_096578311.1

SEQ ID NO: 205

ATGCTGCCAACTTTACCGCAGAATGATCCCAATCCTAGTGTGCGTCAAGCACAATTGGCTCGCAGCCGATATAT

CTACAAATTTACTCATAAGTACCAAGGCTGTCCCGGAAATTCACCTTTACCTAATGGGATTGCGCTGGCAGAAC

ATGTTCCTCCTGATCAGGAGTTTACTCCAGACTATCTTTTGCGGGTTACTCAGGTTAACGCCACCTTACTGGCA

AACCACGCAGCCATCGACCTGGAGTATCTCACAGGAGGAAACGCAGGTAGCAGCTTTTCGCTGTCTGATTGGT

TAGGATTAACTCGGGCTGTAGGCAATAAACACTTACTTTTTTCCACACCGCTCAAGGTGACTTCCAGGATAGAT

AGTTCTTTTCCGATTAATTTGGATGCCTACGATGCAATGTTTGCGTTGATCCAGAAACCTGAGATTGTTTACAA

GTTAAAGCAAGGCAGGGATGTTTGCGATCGCGCTTTTGCCTGGCAAAGGCTGGCTGGTGCTAATCCGATGGT

TTTGCAAGGTATTACTCATTTACCACCGACGTTTCAGCTTACTAACCAGCAATATCAAGCTGCTATTAGAGATG

AGAACGACACCCTTGAAGCTGCTGGTAAGGAAGGGAGGCTTTACGTTGCTGACTACTCGCTGCTTAGTGGGC

TTCCTCACGGTACTTGGAGTGATGGCGTTCTTGGTGTGCCTCGTAATAAGTATATCTTTGACCCAATCGCTCTA

TTTGCTTGGAAAAAAGAAACTCCACTGGAATTAGGAGGGTTATTACCCGTAGCAATTCAATGCCAACAAACTC

AAGATTCTATTTCGTGGTGTCGTTCGGTTGCACCAATCTTTACTCCTAATGATGGAATCTTCTGGGAAATGGCT

AAAGCTATTGTCCAATCCGCTGATGGTAACATTCAGGAAATGGTCTACCATTTAGGGCACACGCACTTTGTAAT

GGAAGCCGTAATTGTTGCCGCAGAGCGCAATCTAGCTGCTGTTCATCCAATTCATGTACTGCTTAAGCCCCATT

TTGAATTTACGCTATCACTAAATGACTATGCATACAAGCACCTAATTGCACCAGGTGGTGCAGTTGATTCGGTG

ATGGGTTCAACACTTGAAGGCAGCTTAACTCTTATGCTTCGGGGTATGAAAAACTATGCTTTTAATCAAGCTCT

ACCTCCCCTAGATTTCAAAAATCGTGGCGTTGATAATTTAGATGGGTTACCTGAGTATCCTTATCGCGATGATG

GTTTATTAGTTTGGACGGCAATTCGTAAGTTTGTATCCAAATATCTCCGGCTCTACTATACCAATGATATTGATG

TCAAAACCGATACCGAACTCCAAAACTGGGTCAAAAGTATTGGCAATAGTCAAGAAGGAAATATTCAAGGAG

TGGAGGAAATCCAAACCTTAGAAAAGCTGATTGATATGGTAGCCTTAATCATTTTTACCGCTTCAGCACAGCAT

GGGTCACTCAACTACGCACAATTCCCAATGATGGGTTATGTACCGAATGTGTCTGGAGCAATTTACGCAGAAG

CTCCCACAAATACAACTCCTCAGAATCAAGACAATTATTTAATGTTGTTGGCTCCCGTACAACAAGCCCTGATA

CAGTTCACAACTCTATATCAATTGTCGAACGTACGCTACGGTAAATTAGGTCATTATCCCTGCTTATATTTTCAA

GATTCGCGAGTACTTCCTTTAGTCAAGGAATTCCAGCAGAACTTAGCTGTTGTTGAGTCAGAAATTCTTGATCG

CGACCAAACTCGTTTTATGTCATATCCTTTTCTGCTTCCCTCTCAAATTGGGAACAGCATCTTTATTTGA

Amino acid Sequence for WP_096578311.1

SEQ ID NO: 206

MLPTLPQNDPNPSVRQAQLARSRYIYKFTHKYQGCPGNSPLPNGIALAEHVPPDQEFTPDYLLRVTQVNATLLANH

AAIDLEYLTGGNAGSSFSLSDWLGLTRAVGNKHLLFSTPLKVTSRIDSSFPINLDAYDAMFALIQKPEIVYKLKQGRDV

CDRAFAWQRLAGANPMVLQGITHLPPTFQLTNQQYQAAIRDENDTLEAAGKEGRLYVADYSLLSGLPHGTWSDG

VLGVPRNKYIFDPIALFAWKKETPLELGGLLPVAIQCQQTQDSISWCRSVAPIFTPNDGIFWEMAKAIVQSADGNIQ

-continued

EMVYHLGHTHFVMEAVIVAAERNLAAVHPIHVLLKPHFEFTLSLNDYAYKHLIAPGGAVDSVMGSTLEGSLTLMLR

GMKNYAFNQALPPLDFKNRGVDNLDGLPEYPYRDDGLLVWTAIRKFVSKYLRLYYTNDIDVKTDTELQNWVKSIG

NSQEGNIQGVEEIQTLEKLIDMVALIIFTASAQHGSLNYAQFPMMGYVPNVSGAIYAEAPTNTTPQNQDNYLMLL

APVQQALIQFTTLYQLSNVRYGKLGHYPCLYFQDSRVLPLVKEFQQNLAVVESEILDRDQTRFMSYPFLLPSQIGNSI

FI

Coding sequence for RCJ33284.1

SEQ ID NO: 207

ATGACTGCTTCATCACCAGAAAATTCAATTAGCTCATCAAGTACTCATACTTTAGACATAGCTAGGCAAGAGTA

TCAATATAACTACACCCATATTCCATCTATTGCGATGCTAGATCGGCTTTCTATTGCCGAAGAGTTCGCTACTAA

CTGGTATTTTTTATTAGCCCAGCAGTTACGAGTTGTGTTTATTAATACCTTGATTGTCAACAGAGGCAATCAAG

GTTCTAAATCGATTCGTGATGATGTCGAAAGGTTTATTTTAGAAGCCTTTCTCAAGGGAGCAGTACCAGTAAA

AATCAGTATTCTGGCAAGAATCCTGCAAATTATCCCTCAGTTTTTGCTCAAAAGCATATCTCAGGATGTTAGAG

AACTCGACGATCTTTTTTATTCTATTCTGAAAGAAAACGGACTTGTAATCCTCAGAGATGCCCTAAATAGGATA

ATTAACCTTCTATATGAAGGACAACCTACAGGACATGCAACCAGTCTCAAGGACTACGAAAATTTGTTTCCGGT

GATTGGTGTGCCAGCGATCGCTAAAACTTACCAAGAAGACGAAGTATTTGCTTACATGCGAGTGGCTGGCTAC

AATCCCGTCACGATCGCGCGAGTAACGACTCCAGGCGATCGCTTCCCAGTCACAGACGAACATTACCAAGGCG

TGATGGGAACTGACGATTCATTAGCAGCAGCCGGACTTGAAGGCAGACTCTACTTAGCTGACTATAAAATTTT

AGATGGTGCGGTCAACGGTACATTCCCACACGAGCAAAAATATCTCTATGCTCCCCTAGCACTGTTTGCCTTAC

CCAAAGGCTCAGACCCCACCCGTTTATTGCGTCCGATAGCCATTCAATGCGGTCAAACACCAGACCCAGATTAT

CCAATTGTTACCCCTAACTGCAGTAAATACTCTTGGCTTTTTGCCAAAACAGTAGTCCAAATAGCAGATGCCAA

CTACCACGAAGCTGTTACTCATCTAGCAAGAACTCACCTGTTTGTTGGTGTTTTTGCGATCGCCACCGCAAGAC

AACTGCCACTCACCCATCCCCTAAGAATTCTACTGCACCCGCATTTTGACAGCACTTTAGCAATTAACGATGCT

GCTCAACGGATTCTCATAGCTCCAGGCGGTGGTGTCGATAGATTACTCTCATCATCAATCGATAACTCTCGCGT

TTTAGCAGTGCTAGGCTTACAAAGCTATGGTTTTAACAGTGCCATCTTACCTAAGCAATTCCAACAGCGTGGTG

TAGACGATCCCAACCTCTTGCCTGTTTATCCTTACCGGGATGATGCACTATTAGTCTGGGATGCCATTCATCAAT

GGGTTTCAGACTACCTAAACCTTTACTACACCACCGATGAAGACATTCAAAAAGACAGAGCATTGCAAGCGTG

GGCAGCCGAAATCCCAGCTTACGATGGTGGTCGCATTCCCGATTTTGGCGAAGATGGAGGCATCAAAACGCG

CAATTATCTAATTGATGCCACTACGCTGATTATTTTCACTGCCAGCGCCCAACACGCTGCGGTTAACTTTCCGCA

AAAAGATTTTATGGGCTACGCCGCAGCGATTCCAATGGCAGGTTATTTACCAGCCTCAACTCTCAAAAGAGAA

GTTACTGAGCAAGACTACCTTAATTTGCTCCCTCCGTTAGATCAGGCGCAACGGCAATACAACCTACTCAGCTT

ATTGGGGTCTGTGTATTACAACAAGCTGGGTGATTATCAGCAAGGATACTTTACAGACCAGAAAGTAAAACCA

TTGCTACAAGCATTCCAGAGTAATCTTCAGCAGGTAGAAGATACGATCAAGCAACGTAATTTGCGCCGTCCAT

CCTATGAGTATCTACTTCCTTCTAAAATTCCTCAGAGCATCAATATCTGA

Amino acid Sequence for RCJ33284.1

SEQ ID NO: 208

MTASSPENSISSSSTHTLDIARQEYQYNYTHIPSIAMLDRLSIAEEFATNWYFLLAQQLRVVFINTLIVNRGNQGSKSI

RDDVERFILEAFLKGAVPVKISILARILQIIPQFLLKSISQDVRELDDLFYSILKENGLVILRDALNRIINLLYEGQPTGHAT

SLKDYENLFPVIGVPAIAKTYQEDEVFAYMRVAGYNPVTIARVTTPGDRFPVTDEHYQGVMGTDDSLAAAGLEGRL

YLADYKILDGAVNGTFPHEQKYLYAPLALFALPKGSDPTRLLRPIAIQCGQTPDPDYPIVTPNCSKYSWLFAKTVVQI

ADANYHEAVTHLARTHLFVGVFAIATARQLPLTHPLRILLHPHFDSTLAINDAAQRILIAPGGGVDRLLSSSIDNSRVL

AVLGLQSYGFNSAILPKQFQQRGVDDPNLLPVYPYRDDALLVWDAIHQWVSDYLNLYYTTDEDIQKDRALQAWA

AEIPAYDGGRIPDFGEDGGIKTRNYLIDATTLIIFTASAQHAAVNFPQKDFMGYAAAIPMAGYLPASTLKREVTEQD

-continued

YLNLLPPLDQAQRQYNLLSLLGSVYYNKLGDYQQGYFTDQKVKPLLQAFQSNLQQVEDTIKQRNLRRPSYEYLLPSK

IPQSINI

Coding sequence for WP_052555973.1

SEQ ID NO: 209

ATGGCGCGAACCGCTCGGTACCGGTTCGGACCCGAATTGCCCGGCGCCCGACCCGATGCCCAGGTGGTTCAC

CCGATGAGCGCATTTCTGCCCGCGTTCGATCCGGACCCGGAAACCCGTGCCGCCGGGCGCGCCGCGAAGCGG

GGCGAGTACACGTACAACCACGAATACGTTTCGCCGCTCGCGTTCGTCGGGGAGGTGCCCAGCCGCGACCGG

TTCCCCATCGATTTCACCACGCTCGTTCTCGGCAAGATCATGACGAACGTGGCGAACCAGGCGGACGCGGATT

CCGCGCTGCGCCGGCGCCTGCGCGCGATGGACGTCCCGATCGCCGACATGGTGCTCGCCGGGTCGACGGCCG

TTCGCGCCGTCGGCGCCGCGGTGGGTGCCGTGATCGGGGCGGCGGCGGATGCCCGTCGGTTGCAAACGATC

GACGACTACAACGCTCTCTTCCACGTCATCGGGCTGCCGCCGATCGCGAAGGACTTTGAATTCGACAGCACGT

TCGCGGAATTGCGGCTCGCCGGGCCGAACCCGGTGATGATTCACCGGGTCGACAAGCCGGACGATCGATTCC

CGGTCACGGACGCGCATTTTCAGGTCGCACTGCCCGGCGACACCCTCGCGGCGGCCGGGGCGGAAGGGCGA

CTGTTTCTGGTGGACTACCAGAGACTTGACGGGGTCGAGACCGGTGTAAGCCCGTGCGGGCTGCCGAAGTAC

CTCTACGCCCCGCTCGCGCTGTTCGCGGTGAACAAGGACACGCGAAAACTGGTCCCGGTCGCGATCCAGTGC

AAGCAGCGGCCGGGACCGGAGAACCCGATCTTCACGCCGGACGACGGCTACAACTGGCGGATCGCCAAGAC

GATCGTGGAAATCGCCGACGGCAACTACCACGAGGCGATCACGCACCTCGGGCGCACGCACCTGACGGTCGA

GCCGTTCGTGGTCGCGGCGCACCGGCAGTTCGGTCCGAACCACCCGCTCAATGTGCTGCTCCAACCGCACTTC

GGTGGCACACTCGCGATCAATCACCTCGCGCGTCTCAAACTGATTTCGCCCGATGGCGTCGTGGACCGGCTCC

TCGGCGCGAAGATCTCCGCGGCGCTGGAACTCAGCGCGTGGGGGGTGCAGGGCCACGCCTTCATGGATTTGC

TGCCGCCGGCGTCGTTTCGGCGCCGCGGGGTCGATAACACGGCCACCTTGCCGAGCTACTCCTACCGCGATGA

CGCCCTCTTGCACTGGGAGGCCGTTCGCGAGTGGGTCGCGACGTACCTGCGGTGCTTCTACCGGTCCGATGCC

GAAGTCGCGGCGGACGTGGAAGTCGCGGCGTGGCTCACGGAGGCGTCCGCGAAGACCGGCGGGCGCATCA

ACGGGATCGAACCGGCCCGCACCTTCGCGGAACTGGTCGACGTGACCGCCCTTGTGATTTTCACCGCGAGCGC

GCAGCACGCGGCGGTGAACTTCCCGCAATACGACATCATGAGTTACGCCCCCGCGATGCCGCTCGCGGGTTA

CGCCCCGGCGCCCACGAGCAAGACCGGCGCCACAGAAGCCGACTACATGGCGATGCTGCCACCGCGGGACC

AGGCCGCGCTCCAGATGAACACCGGCTTCATGCTCGGAACGGCGCACTACACGCGGCTGGGGCACTACGAAC

CGGGGTACTTCGGCGAACCGCGCATTAACGAACTAGCGGCGCGATTCGCGGCGAAGATGGACGAGATCGAG

GCCACCATCACGGAAAGAAACCGGCACCGCCGGCCGTACCCGTTTATGCTGCCATCGGGTGTGCCGCAGAGC

ATCAACATTTGA

Amino acid Sequence for WP_052555973.1

SEQ ID NO: 210

MARTARYRFGPELPGARPDAQVVHPMSAFLPAFDPDPETRAAGRAAKRGEYTYNHEYVSPLAFVGEVPSRDRFPI

DFTTLVLGKIMTNVANQADADSALRRRLRAMDVPIADMVLAGSTAVRAVGAAVGAVIGAAADARRLQTIDDYNA

LFHVIGLPPIAKDFEFDSTFAELRLAGPNPVMIHRVDKPDDRFPVTDAHFQVALPGDTLAAAGAEGRLFLVDYQRLD

GVETGVSPCGLPKYLYAPLALFAVNKDTRKLVPVAIQCKQRPGPENPIFTPDDGYNWRIAKTIVEIADGNYHEAITHL

GRTHLTVEPFVVAAHRQFGPNHPLNVLLQPHFGGTLAINHLARLKLISPDGVVDRLLGAKISAALELSAWGVQGHA

FMDLLPPASFRRRGVDNTATLPSYSYRDDALLHWEAVREWVATYLRCFYRSDAEVAADVEVAAWLTEASAKTGG

RINGIEPARTFAELVDVTALVIFTASAQHAAVNFPQYDIMSYAPAMPLAGYAPAPTSKTGATEADYMAMLPPRDQ

AALQMNTGFMLGTAHYTRLGHYEPGYFGEPRINELAARFAAKMDEIEATITERNRHRRPYPFMLPSGVPQSINI

Coding sequence for WP_103667398.1

SEQ ID NO: 211

ATGATCTTCTCGCTTTTGAGTGGTGTTGCCAGAGTATTAAATTTCGTTTCGGCTAAGTTAACAGACTTAGCCAA

TTTAATATCAAGGCGATCGCAGTCAAGCAAATACCCGCTGTTGCCTCAGAATGATCCCGCAACTACTCAGCGTC

-continued

AAGCATCTCTAAATCAATCTAGGCAACTCTATCAATATAACTACACCTATATTGAGTCATTGCCAATGGTAGAG

AAGGTTCCCAAGAATGAGAGATTTTCTCTATCTTGGGGATTATTAGTTGGGAAGGTAGTGGTCAAAGTTTTGT

TAAATGATCGAGCTAATCCTTCGGCATTCATTGACAAAGAGAAATCTAAAGCACAACAACTAGACTTCTCAAA

ACGTTTGCTTGAAGCTAGCATGTCTCAGTCTGAAAATGCATTAATAGAACTATTGTCCGAATTGCCAACAATTC

TTGAAGATGAGCCAATTGATTTAGAAGGGTCAAACATTCAAGAATACAACAATCTTTTTTGGATTATTCCTCTA

CCTGCAATCAGTCAAAATTTTAAGAGCAATTCAGAATTTGCAAGGTTACGCGTTGCTGGCTTTAATCCTCTAGT

GATTCAAAAGGTTAAGGCTTTGGATGCCAAATTCCCCTTGACTGAGGCGCAATTCCAGAAGGTTTTGGCTGGT

GATTCTTTAGCTGCGGCAGGAGCAGAAGGGCGTTTGTATTTGGCTGATTATGTAGAACTAACCGCGATCGCAG

GCGGCACTTTCCCTAAATCAGAACAGAAATATATCAACGCACCTTTAGCTCTATTTGCGATTCCTAAAGGGAAA

AAGAGCCTGACTCCGATCGCCATTCAACTAGGACAAGATCCGAATACTAATCCCATCTTTGTCTGTCAAGCTGG

TGATGAGCCAAACTGGATGCTAGCAAAAACTGTTGTCCAAATTGCCGATGCTAATTACCATGAACTAATTAGT

CATTTGGGTAGAACTCATCTATTTATCGAGCCTTTTGCGATCGCTACTAATCGCCAACTCGCCAGTAATCATCCT

CTATATGTTTTACTAAAGCCACATTTTCAAGGGACTTTAGCGATTAATGATGCGGCTCAGTCAGGACTGATTAA

TGCAGGTGGAACCATTGATAGTCTATTAGCAGGCACGATTACTTCGTCTCGCGCACTTTCAGTTCAGGGTGTA

AAAACCTATAACTTTGATGAGGCGATATTGCCTGTAGCTTTGAAGAAGAGAGGAGTTGATGATCCAAACCTAT

TGCCAGACTATCCCTATCGCGATGATGCTTTGTTAGTTTGGGATGCTATTTCAACTTGGGTTAAAAGCTATCTA

TCGATCTATTACTTCAATGACAATGATGTGATTAGAGATTCGGAACTGCAAGCTTGGGCACAGGAAATCATTT

CTGACAATGGTGGTCGCGTAACTAGTTTCGGACAGAGTGGACAGATTCGCACTTTTGATTATTTAGTCAATGCT

GTAACTCTACTAATCTTTACTGGTAGTGCTCAACATGCGGCGGTGAACTTCCCCCAAGGCGACTTGATGGTTTA

TGCTCCCGCATTTCCTCTAGCTGGCTATACCCCTGCACCAACTTCAACCACAGGTGCAAGCGAGGCAGATTTCT

TTGCAATGTTGCCTCCTATCGATCAGGCTAAGAGCCAATTGACGATGACTTATATTCTTGGTTCGGTCTATTAC

ACGACCTTGGGTGAGTATGGGCCTAGTTATTTCAATGACGATCGCATTAAGCAGCCCCTACTCGATTTCCAAG

ATCAGTTAAAGGCGATCGAGTCAACAATCAAGTCTCGTAATGAAAAACGAGTTACGGACTATAACTATTTGAG

ACCATCACGGATTCCTCAAAGTATTAATATCTAA

Amino acid Sequence for WP_103667398.1

SEQ ID NO: 212

MIFSLLSGVARVLNFVSAKLTDLANLISRRSQSSKYPLLPQNDPATTQRQASLNQSRQLYQYNYTYIESLPMVEKVPK

NERFSLSWGLLVGKVVVKVLLNDRANPSAFIDKEKSKAQQLDFSKRLLEASMSQSENALIELLSELPTILEDEPIDLEG

SNIQEYNNLFWIIPLPAISQNFKSNSEFARLRVAGFNPLVIQKVKALDAKFPLTEAQFQKVLAGDSLAAAGAEGRLYL

ADYVELTAIAGGTFPKSEQKYINAPLALFAIPKGKKSLTPIAIQLGQDPNTNPIFVCQAGDEPNWMLAKTVVQIADA

NYHELISHLGRTHLFIEPFAIATNRQLASNHPLYVLLKPHFQGTLAINDAAQSGLINAGGTIDSLLAGTITSSRALSVQG

VKTYNFDEAILPVALKKRGVDDPNLLPDYPYRDDALLVWDAISTWVKSYLSIYYFNDNDVIRDSELQAWAQEIISDN

GGRVTSFGQSGQIRTFDYLVNAVTLLIFTGSAQHAAVNFPQGDLMVYAPAFPLAGYTPAPTSTTGASEADFFAMLP

PIDQAKSQLTMTYILGSVYYTTLGEYGPSYFNDDRIKQPLLDFQDQLKAIESTIKSRNEKRVTDYNYLRPSRIPQSINI

Coding sequence for WP_023071825.1

SEQ ID NO: 213

ATGACTGCAAGCTACTCCAACCCAGACCAACATAAAAAACGTTTAGAATATCAATACAACTATACCCATATTCC

GCCCATAGCTATGGTGGATAAGCTATCAGAGGAAGAGCAATTTTCTTCGCGATGGCGTTTGATGGTGGCTAAA

GTTGGTTTTGAAATACTGGTTAATACGATTATTGTCAATCGAGGTGATCAAGGTAAATCAGGAGCCGCAGACG

ATGTTAAAGCCTTTCTCATAGAGACTTTTCAGGAGACTTTAGCAGACTATTCAGTGAGGTCTCGGCTGAAAATC

CTCTGGCAGGGAGCAAAGTTTATACCCAGGATTCTATTTACGCGGTTATCCTTAAAGGCAGAAGAGCTAGAAA

ACCTGATCAAAGAGATTATTCAGAGTGTCAATGGCGATTTTCTACGAGATTTTGCCGCCAATGTGCAACAGAA

-continued

GTTAAAACTCGATGCGCCTGTAGGGCGCGGCCAGGACATTAAAGATTTTCAGGCTCTGTTTCAAACGATTGAC

TTACCAGACATCGCCTACACCTACGAAACCGATGAGGTGTTTGCATCAATGCAGGTAGCCGGGCCAAATCCAG

TCATGATCAAGCGGCTGTCAACACCGGATGCTCGTCTGCCCATCACAGAGACTCTGTACAAAGGGGGCATGG

GAGAAACGGATTCCCTGGCCGATGCCTATGCTGAAGGACGTTTATACCTAGCTGATTATGGCATTCTGGATGG

AGCCATCAACGGTTCATTTCCTGAGGCGCAGAAATATCTCTACGCGCCACTTGCGTTATTTGCTGTAGCAAAAA

CGGGCGATCGCCGTTTGCGGCCAGTAGCAATTCAATGTGGGCAAAATCCCGAGGAGTTTCCTCTTTATACCCC

GCAATCAAATCCCTATGCCTGGCTCTGTGCAAAGACCATGGTGCAGATTGCTGATGCTAATTTCCATGAGGCA

GTCACCCATCTGGCACGTACTCATTTGTTGATTGGACCATTTGCGATCGCAACCCACCGCCAACTATCCGACGA

CCATCCCCTCAGCCTCCTGCTCCGCCCCCACTTCCAGGGCATGCTAGCCATCAATAACGAAGCCCAAGCCAAGC

TGATCGCCCCTGGCGGTGGCGTCAACAAGATTCTCTCAGCCACCATCGATACCTCGCGAGTATTTGCTGTCATC

GGCGTCCAGACCTACGGCTTTAACTCCGCCATGTTACCCAAACAACTTCAGCAGCGCGGAGTAGACGATACAG

ATAGCCTCCCCATTTACCCCTACCGTGACGACAGCATCTTAATTTGGGACGCCATTCATGACTGGGCCGAAAAC

TATCTCAGCCTCTACTATGCCAATGATGCGGCCGTTCAGCAGGATAACGCTCTACAGGCATGGGCACAGGAAC

TAAGCGCCCACAATGGCGGTCGCGTCCAAGAATTCGGCGAAGCCGAAGGGCAGCTCCAAACCCTTGCATATC

TGATTGACGCCATCACGCTGATTATATTCACCGCTAGCGCCCAACATGCAGCAGTCAATTTCCCCCAAAAGGAA

ATCATGAGCTACGCCCCAGCCATGCCAACCGCTGGCTATGCCGCATTAGAAAATCTCGGAGAGCACACCACTC

AAGCAAACTACCTGAGCTTATTACCCCCCATCGACCAAGCGCAGGAGCAACTTAAGTTATTGCATCTGCTAGG

CTCTGTCCACTTCACACAGTTAGGACAGTACGAGAAAAATCATTTCCAGGATGCCAATATCAAAATCCCGCTAG

AACAGTTTCAAAACCGTCTCGAAGAGATTACAGATATTATCCATGAGCGTAATCGCGATCGGTCTCCCTACGA

GTATTTACTACCCAAAAATATTCCCCAAAGCATCAATATCTAG

Amino acid Sequence for WP_023071825.1

SEQ ID NO: 214

MTASYSNPDQHKKRLEYQYNYTHIPPIAMVDKLSEEEQFSSRWRLMVAKVGFEILVNTIIVNRGDQGKSGAADDV

KAFLIETFQETLADYSVRSRLKILWQGAKFIPRILFTRLSLKAEELENLIKEIIQSVNGDFLRDFAANVQQKLKLDAPVG

RGQDIKDFQALFQTIDLPDIAYTYETDEVFASMQVAGPNPVMIKRLSTPDARLPITETLYKGGMGETDSLADAYAE

GRLYLADYGILDGAINGSFPEAQKYLYAPLALFAVAKTGDRRLRPVAIQCGQNPEEFPLYTPQSNPYAWLCAKTMV

QIADANFHEAVTHLARTHLLIGPFAIATHRQLSDDHPLSLLLRPHFQGMLAINNEAQAKLIAPGGGVNKILSATIDTS

RVFAVIGVQTYGFNSAMLPKQLQQRGVDDTDSLPIYPYRDDSILIWDAIHDWAENYLSLYYANDAAVQQDNALQ

AWAQELSAHNGGRVQEFGEAEGQLQTLAYLIDAITLIIFTASAQHAAVNFPQKEIMSYAPAMPTAGYAALENLGE

HTTQANYLSLLPPIDQAQEQLKLLHLLGSVHFTQLGQYEKNHFQDANIKIPLEQFQNRLEEITDIIHERNRDRSPYEYL

LPKNIPQSINI

Coding sequence for WP_096618242.1

SEQ ID NO: 215

ATGCGATCGCCAACTCCAAAGCAACGACGACAAGAGTTAATAGATACATATATTTTATCACGTCGTAGCATGA

TGATGCTAATGGCTGTAGCTGCTACTCCGGGTATAGAAATGTTACTGTTCGGTGGGAATAAATCCTCACAAGC

TAGTGCAACAGGTAATTTTGAAAATTGCAATCCGGGTTTGGAAACTTTACTATCCAATGAAAATCAACCCTCAA

AACCCAAACCACCAAATAATCCCAACATCCCTACCTTACCTCACAAGGATACAAAAGCAACTCAACAAGAACGC

CTGCTTCAGTTGGGCAAGGCTCGCGAAGAATATCAGACAGGGTTACGGCTGCCTAATTCTGCGAAAGTGAAG

ACTTTACCCGCTCAAGAAGCATTTTCGGAAAGATATAACAATAATCGAGTCATCTTATCGGAGAAAATAGCAG

CTAATCAACAAGCATTTCTCAGCAATCCTCAACCTTTTCAAAGCTTCGATGACTACGCGGCGTTGTTTCCCGTTT

TGCCGTTACCAGGTATTGCTAAAACCTTCCGCAACGATGATGTATTTGCACGGCAGCGTCTTTCTGGCTGCAAT

CCCATGGAACTGAAGAACGTTCTCAAACTGGGTTACAGTCTTCGCGACAAAATGGGGATAACGGATGAGATT

TTTCAAGCTGTACTGGGCGCGACAAGAGGCAGAAAGCCGATTCATAATAATCAGACTCTCAACAGCGCTATTC

-continued

GAGAAGGGAGTTTATTTGTCACAGACTATGCGGTACTTGATAGCGTTACACCGAAGGAAACGCAATATTTGTG

CGCCCCCATTGCCCTCTATTATGCCGCAAGGATTCGCGGCGATTTTCATTTAATTCCCATTGCTATCCAGTTGGG

ACAGGTACCAGGAGAAAGTTTACTTTGTACACCTTTAGATGGCGTAGATTGGACTTTAGCCAAATTAATTACCC

AGATGGCTGATTTCTCCATCAATCAACTGTACCGTCACTTGGGACAAACTCATCTAGTAATGGAACCAATCGCC

TTAGCAACAGTACGCGAACTAGCTGCTCGCCATCCCGTCAACGTCCTCTTAAAGCCTCATGTTGAATTTACAAT

GGCAATTAATAGCCTTGGTGATCAGGTGTTGATTAATCCGGGGGGAGCAGTAGATGTTATCTTACCAGGCACT

TTGGAAAGCTCACTCAAACTCACCGAAAGAGGGGTATCCGACTTTTGCAACAACTTCAGCAACTTTGCACTCCC

GACTAATTTACGTCAGCGCGGTGTTGATAATTCTTCGATTCTGCAAGATTTTCCCTATCGAGACGACGGCTTGC

TCATCTGGAATGCCTTAGAAGAATATGTGAGTCAATATATCGGAATTTACTACAAATCCAACCGAGATATCCGC

GAGGATTTCGAGCTACAAAAATGGTTCCAAGCTTTACGGAAACCCGTTAGTGAAGGTGGTTTTGGTATAGTTT

CATTACCAGCAAGCTTGACGAACCGCAACCAATTGATAGATATTTTGACAATCATTATTTTCACCGCAGGTCCG

CAACACTCAGCGATCGCTTGGACTCAATATCAATACATGGCTTTTATTCCGAATATGCCCGGAGCGCTTTATCA

GCCTATTCCCACAACCAAAGGAAAATTTGCAAATGAAAATAGCCTCACGAGTTTCCTACCGGGAGTCAAACCA

AGCCTTACTCAAGTCCAGTTTATGTCGTTAGTCGGTACCAAGCGCGACCCCAAGGCGTTTACAGACTTCGGTAC

AAATAGTTTTCAAGACCCTCGAGCCATTAGGGTTCTTAGAGATTTGCAGAATCGCTTAGAGTCAGTAGAAAAA

CGGATTAAAATACTTAATAAACGTCGCCAAGAATGCTACCCTGCTTTTCTACCCTCTCGAATGTCGAATAGTGT

CAGTGGATAG

Amino acid Sequence for WP_096618242.1

SEQ ID NO: 216

MRSPTPKQRRQELIDTYILSRRSMMMLMAVAATPGIEMLLFGGNKSSQASATGNFENCNPGLETLLSNENQPSKP

KPPNNPNIPTLPHKDTKATQQERLLQLGKAREEYQTGLRLPNSAKVKTLPAQEAFSERYNNNRVILSEKIAANQQAF

LSNPQPFQSFDDYAALFPVLPLPGIAKTFRNDDVFARQRLSGCNPMELKNVLKLGYSLRDKMGITDEIFQAVLGATR

GRKPIHNNQTLNSAIREGSLFVTDYAVLDSVTPKETQYLCAPIALYYAARIRGDFHLIPIAIQLGQVPGESLLCTPLDGV

DWTLAKLITQMADFSINQLYRHLGQTHLVMEPIALATVRELAARHPVNVLLKPHVEFTMAINSLGDQVLINPGGA

VDVILPGTLESSLKLTERGVSDFCNNFSNFALPTNLRQRGVDNSSILQDFPYRDDGLLIWNALEEYVSQYIGIYYKSNR

DIREDFELQKWFQALRKPVSEGGFGIVSLPASLTNRNQLIDILTIIIFTAGPQHSAIAWTQYQYMAFIPNMPGALYQP

IPTTKGKFANENSLTSFLPGVKPSLTQVQFMSLVGTKRDPKAFTDFGTNSFQDPRAIRVLRDLQNRLESVEKRIKILN

KRRQECYPAFLPSRMSNSVSG

Coding sequence for WP_107806740.1

SEQ ID NO: 217

ATGACTACTTCATCACCAGATAATTCCCGCAGTCTCCCCATCACCCAGAACTTGGAGTTAGTGAGGCAGGAAT

ATCAATATAACTATACCCATATTCCACCTATTCCTATGGTGAATCAGCTTCCTAATCAGGAAAACTTCACTACTA

GATGGACTTTTTTATTAGCCCAGCAGTTACGGGAGATTTTCATTAATACTCTGATCACTAACCGAGGCGATCGC

AGTTCCAAATCGGTTCGTGATCAAGTCAAAAGGTTTATTTTAGAAGCCTTGTTCAAGGGGGGCTATACCAGCCA

AAGTAAGTGTGATTGCGAGACTTTTCCAAATTATTCCCCAGTTTCTCATTCAAGGAATATCTAAAGATTTTCACG

AACTAGATGATCTGTTTTTTTCCCTTTTCAAAACCAACGGACTGTTAATATTCAGAGATTCTCTGAATCGAATTA

CAGCCCTTTTAGATAAAGGCCATCCCACAGGTCATGTGAATAGTTTAAAGGACTACCAAAAGTTATTTACCACA

ATTGAATTACCAGCGATCGCCAAAACTTTCGATCAAGATCAAGTCTTTGCCTATATGCAAGTCGCCGGCTACAA

TCCCCTAGTAATCAAGCGGGTAAAAAGTCCAGGCGCTAACTTCCCAGTTGAAGATACACATTACCAAGCAGTA

ATGGGGAGTGATGATTCATTAGCAGCCGCAGGACAAGAAGGACGGCTATACCTAGCAGACTATCAAATTTTA

GACGGTGCTATCAACGGTATATATCTAAATTACCAAAAGTATGCCTATGCTCCCCTAGCGCTGTTTGCCATCCC

CAAAAACTCAGACCCAAATCGTCTACTGCGCCCCATAGCTATTCAATGTGGTCAAACTCCTGGAGCCGATTATC

-continued

CCATCATTACCCCCAATTCCGGCAAATACGCCTGGCTATTTGCCAAAACCATTGTCCACATAGCAGATGGCAAC

TTTCATGAAGCTGTCAGTCACCTAGCCCGAACGCACCTATTCGTTGGTGTCTTTGTCATCGCCACCCATCGGCA

ATTGTCCCCCAGCCATCCCCTCAGCCTCCTACTGCGTCCCCATTTTGAAGGCACTTTAGCGATTAACAATGCCGC

CCAAGAAGTTTTGATTGCTCCTGGCGGCGGAGTTGATATATTGCTTTCATCGACAATTGATAACTCTCGGATTT

TAGCAGTGCGCGGTTTGCAAAGCTATAGTTTCAATGAAGCTATGTTGCCAAACCAACTCAAACAACGAGGTGT

TGATGATCCTGAACTACTGCCTGTTTATCCTTACCGGGATGATGCATTACTAATTTGGAACGCCATTCATCAAT

GGGTTTCCGACTACCTGAGCCTTTACTACCCTACAGATAAAGATATTCAAAATGATACTGCTTTGCAAGCATGG

GCAGCCGAAGCCAAAGCTGACAATGGTGGACGTGTACCTGATTTTGGTGAAAATGGAGGTATTCAGACACTA

GACTACCTAGTTGATGCTGCTACCCTGATTATTTTTACAGCCAGCGCCCAACACGCTGCGGTTAACTTCCCCCA

AAAAGATTTGATGAGTTATGCCCCTGCTTTTCCCTTAGCAGGATATGTATCCGCCTCCATCAACGGAGAAGTTA

GTGAGCAAGACTACCTGAATTTACTCCCACCTTTGGAGCAAGCGCAACAGCAATTTAACTTGCTCACTTTACTA

GGGTCTATATATTACAACCAGCTTGGTGAATATCCAAAATCACACTTTGCTAACCCCAAGGTACAAATCTTGTT

ACAGAAGTTCCAAAGCCGTCTTCAGCAAATTGAAATTACGATCAATCAGCGCAATTTGCACCGCCCAACTTACG

AATATCTACTTCCTTCTAAAATCCCTCAGAGCATTAATATTTGA

Amino acid Sequence for WP_107806740.1

SEQ ID NO: 218

MTTSSPDNSRSLPITQNLELVRQEYQYNYTHIPPIPMVNQLPNQENFTTRWTFLLAQQLREIFINTLITNRGDRSSKS

VRDQVKRFILEALFKGAIPAKVSVIARLFQIIPQFLIQGISKDFHELDDLFFSLFKTNGLLIFRDSLNRITALLDKGHPTGH

VNSLKDYQKLFTTIELPAIAKTFDQDQVFAYMQVAGYNPLVIKRVKSPGANFPVEDTHYQAVMGSDDSLAAAGQE

GRLYLADYQILDGAINGIYLNYQKYAYAPLALFAIPKNSDPNRLLRPIAIQCGQTPGADYPIITPNSGKYAWLFAKTIV

HIADGNFHEAVSHLARTHLFVGVFVIATHRQLSPSHPLSLLLRPHFEGTLAINNAAQEVLIAPGGGVDILLSSTIDNSR

ILAVRGLQSYSFNEAMLPNQLKQRGVDDPELLPVYPYRDDALLIWNAIHQWVSDYLSLYYPTDKDIQNDTALQAW

AAEAKADNGGRVPDFGENGGIQTLDYLVDAATLIIFTASAQHAAVNFPQKDLMSYAPAFPLAGYVSASINGEVSEQ

DYLNLLPPLEQAQQQFNLLTLLGSIYYNQLGEYPKSHFANPKVQILLQKFQSRLQQIEITINQRNLHRPTYEYLLPSKIP

QSINI

Coding sequence for WP_017804222.1

SEQ ID NO: 219

ATGACTACTTCATCACCAGATAATTCCCGCAGTCTCCCCATCACCCAGAACTTGGAGTTAGTGAGGCAGGAAT

ATCAATATAACTATACCCATATTCCACCTATTCCTATGGTGAATCAGCTTCCTAATCAGGAAAACTTCACTACTA

GATGGACTTTTTTATTAGCCCAGCAGTTACGGGAGATTTTCATTAATACTCTGATCACTAACCGAGGCGATCGC

AGTTCCAAATCGGTTCGTGATCAAGTCAAAAGGTTTATTTTAGAAGCCTTGTTCAAGGGGGCTATACCAGCCA

AAGTAAGTGTGATTGCGAGACTTTTCCAAATTATTCCCCAGTTTCTCATTCAAGGAATATCTAAAGATTTTCACG

AACTAGATGATCTGTTTTTTTCCCTTTTCAAAACCAACGGACTGTTAATATTCAGAGATTCTCTGAATCGAATTA

CAGCCCTTTTAGATAAAGGCCATCCCACAGGTCATGTGAATAGTTTAAAGGACTACCAAAAGTTATTTACCACA

ATTGAATTACCAGCGATCGCCAAAACTTTCGATCAAGATCAAGTCTTTGCCTATATGCAAGTCGCCGGCTACAA

TCCCCTAGTAATCAAGCGGGTAAAAAGTCCAGGCGCTAACTTCCCAGTTGAAGATACACATTACCAAGCAGTA

ATGGGGAGTGATGATTCATTAGCAGCCGCAGGACAAGAAGGACGGCTATACCTAGCAGACTATCAAATTTTA

GACGGTGCTATCAACGGTATATATCTAAATTACCAAAAGTATGCCTATGCTCCCCTAGCGCTGTTTGCCATCCC

CAAAAACTCAGACCCAAATCGTCTACTGCGCCCCATAGCTATTCAATGTGGTCAAACTCCTGGAGCCGATTATC

CCATCATTACCCCCAATTCCGGCAAATACGCCTGGCTATTTGCCAAAACCATTGTCCACATAGCAGATGGCAAC

TTTCATGAAGCTGTCAGTCACCTAGCCCGAACGCACCTATTCGTTGGTGTCTTTGTCATCGCCACCCATCGGCA

ATTGTCCCCCAGCCATCCCCTCAGCCTCCTACTGCGTCCCCATTTTGAAGGCACTTTAGCGATTAACAATGCCGC

CCAAGAAGTTTTGATTGCTCCTGGCGGCGGAGTTGATATATTGCTTTCATCGACAATTGATAACTCTCGGATTT

-continued

TAGCAGTGCGCGGTTTGCAAAGCTATAGTTTCAATGAAGCTATGTTGCCAAACCAACTCAAACAACGAGGTGT

TGATGATCCTGAACTACTGCCTGTTTATCCTTACCGGGATGATGCATTACTAATTTGGAACGCCATTCATCAAT

GGGTTTCCGACTACCTGAGCCTTTACTACCCTACAGATAAAGATATTCAAAATGATACTGCTTTGCAAGCATGG

GCAGCCGAAGCCAAAGCTGACAATGGTGGACGTGTACCTGATTTTGGTGAAAATGGAGGTATTCAGACACTA

GACTACCTAGTTGATGCTGCTACCCTGATTATTTTTACAGCCAGCGCCCAACACGCTGCGGTTAACTTCCCCCA

AAAAGATTTGATGAGTTATGCCCCTGCTTTTCCCTTAGCAGGATATGTATCCGCCTCCATCAACGGAGAAGTTA

GTGAGCAAGACTACCTGAATTTACTCCCACCTTTGGAGCAAGCGCAACAGCAATTTAACTTGCTCAGTTTACTA

GGGTCTATATATTACAACCAGCTTGGTGAATATCCAAAATCACACTTTGCTAACCCCAAGGTACAAATCTTGTT

ACAGAAGTTCCAAAGCCGTCTTCAGCAAATTGAAATTACGATCAATCAGCGCAATTTGCACCGCCCAACTTACG

AATATCTACTTCCTTCTAAAATCCCTCAGAGCATTAATATTTGA

Amino acid Sequence for WP_017804222.1

SEQ ID NO: 220

MTTSSPDNSRSLPITQNLELVRQEYQYNYTHIPPIPMVNQLPNQENFTTRWTFLLAQQLREIFINTLITNRGDRSSKS

VRDQVKRFILEALFKGAIPAKVSVIARLFQIIPQFLIQGISKDFHELDDLFFSLFKTNGLLIFRDSLNRITALLDKGHPTGH

VNSLKDYQKLFTTIELPAIAKTFDQDQVFAYMQVAGYNPLVIKRVKSPGANFPVEDTHYQAVMGSDDSLAAAGQE

GRLYLADYQILDGAINGIYLNYQKYAYAPLALFAIPKNSDPNRLLRPIAIQCGQTPGADYPIITPNSGKYAWLFAKTIV

HIADGNFHEAVSHLARTHLFVGVFVIATHRQLSPSHPLSLLLRPHFEGTLAINNAAQEVLIAPGGGVDILLSSTIDNSR

ILAVRGLQSYSFNEAMLPNQLKQRGVDDPELLPVYPYRDDALLIWNAIHQWVSDYLSLYYPTDKDIQNDTALQAW

AAEAKADNGGRVPDFGENGGIQTLDYLVDAATLIIFTASAQHAAVNFPQKDLMSYAPAFPLAGYVSASINGEVSEQ

DYLNLLPPLEQAQQQFNLLSLLGSIYYNQLGEYPKSHFANPKVQILLQKFQSRLQQIEITINQRNLHRPTYEYLLPSKIP

QSINI

Coding sequence for WP_010472182.1

SEQ ID NO: 221

ATGACGCCACAATATGAATATCGATACGATGCCCTGAAAGACGTTTCCCCTGAATTGAAATATCCAATGGCCA

AGGAGGTGTTTCCAGCAGACCAATCTTTGACAAAATGGCCCTGGACTCGAGATCTCGTTTCCGTTGTCCTCAG

AATTATTGCCAATCAGGCCATGCAGGATATATCCGTCCGTAGAGGATCAGCCTGTCGTCTGATTACGTTTATTC

GCTTATATCGAATTCTAGAAAATCCCCTCTATCAGTCAGGTCTGGAGAGGCTTTTCAATGCTGTCAATAATCTT

GTACGGGGTCTCTCCAATATTTTTGGCAACAGAGCCCAGTCTCAAAATATCAAACATGATGTAAAGGAGGAGC

AACATCCTGACAAAGTCTCCGCCCGCATTTCAGCAATGGTCAAGGATATCCAAGAAACGGCTGAATCGAGAGA

GGCTAAAGAGCAACCGTCCTTAGCAGACTATCGCGATCTCTTTCAGATCATTTACTTACCAGACATTAGCAATC

ATTTCCTAGAAGATCGTGCCTTTGCCGCTCAACGGGTTGCCGGAGCTAACCCCCTCGTGATTAACCGAATTTCT

GAACTCCCAGACCATTTCCAAGTCACTGACCAACAGTTTAAATCGGTGATGGGAGATAGTGAGTCCCTCCAAG

CAGCCTTGAATGATGGCCGAGTGTATCTGGTAGACTATCAAATTCTTGAAGAAATTGATGCGGGTACAGTCGA

GGTGAAGGATCGTGAAATTCTGAAGTATCGCTATGCACCGTTGGCCTTATTTGCGATCGCATCCGGGAATTGT

CCCGGTCGCCTCCTCCAGCCGATTGCCATTCAATGCCATCAAGAAGCAGGCAGCCCGATATTTACACCACCCA

GTCTAGAAGCCGATAAAGAGGAGCGGCTTGCTTGGAGAATGGCCAAGACCGTCGTTCAAATCGCCGACGGTA

ACTACCATGAATTGATTTCTCATTTAGGGCGGACTCATCTCTGGATTGAGCCCATTGCTTTAGGCACTTACCGA

CGCCTAGGAACAGAGCATCCACTGGGTAAATTGCTCCTACCCCACTTCGAAGGCACCTTATTTATCAACAATGC

AGCAGCCAATAGCTTAATTGCCCCGGGTGGCACCGTAGACAAAATCTTGTTTGGCACCTTAAAGTCATCCGTTC

AGCTCAGCGTCAAAGGCGCTAAGGGTTACCCCTTTTCTTTCAATGATTCCATGCTCCCCCAAACCTTTGCATCCC

GAGGCGTGGACGACCTACAAAAGCTACCGGACTACCCCTATCGAGATGATGCATTACTGATTTGGCATGCCAT

TCACGATTGGGTTGAGGCCTATCTTCAGATCTACTACAAAGATGATGATGCAGTTCTCAAGGATGAAACCCTC

-continued

CAGGATTGGTTAACCGAGCTAAGAGCTGAAGATGGGGGCCAGATGACTGAAATCGGTGAATCGACTCCAGA

AGAACCCGAGCCTAAAATTCGCACCTTGGATTATCTAGTAAACGCGACAACGCTGATTATTTTCACTTGTAGTG

CTCAACATGCATCGGTCAATTTTCCCCAAGCATCGTTGATGACGTTTGTCCCCAATATGCCCCTAGCCGGGTTC

AATGAAGGCCCGACAGCAGAGAAAGCCAGTGAAGCAGACTATTTCTCTTTACTACCACCCCTGAGTTTGGCCG

AACAACAGTTGGATCTAGGGTATACCTTGGGTTCGGTCTACTATACTCAGCTCGGATATTACAAAGCCAATGA

TGTAGATTTAGGTGATATTAACAACCATACCTACTTCAACGACCTCCAAGTTAAACAGGCTCTCCTAAGCTTCC

AACAAAGATTAGAAGAGATTGAGTTGATCATTCAAGACCGGAACGAAACCCGACCCACATATTACGACATCTT

GCTCCCGTCCAAGATTCCCCAAAGTACCAACATTTAA

Amino acid Sequence for WP_010472182.1

SEQ ID NO: 222

MTPQYEYRYDALKDVSPELKYPMAKEVFPADQSLTKWPWTRDLVSVVLRIIANQAMQDISVRRGSACRLITFIRLY

RILENPLYQSGLERLFNAVNNLVRGLSNIFGNRAQSQNIKHDVKEEQHPDKVSARISAMVKDIQETAESREAKEQPS

LADYRDLFQIIYLPDISNHFLEDRAFAAQRVAGANPLVINRISELPDHFQVTDQQFKSVMGDSESLQAALNDGRVYL

VDYQILEEIDAGTVEVKDREILKYRYAPLALFAIASGNCPGRLLQPIAIQCHQEAGSPIFTPPSLEADKEERLAWRMAK

TVVQIADGNYHELISHLGRTHLWIEPIALGTYRRLGTEHPLGKLLLPHFEGTLFINNAAANSLIAPGGTVDKILFGTLKS

SVQLSVKGAKGYPFSFNDSMLPQTFASRGVDDLQKLPDYPYRDDALLIWHAIHDWVEAYLQIYYKDDDAVLKDETL

QDWLTELRAEDGGQMTEIGESTPEEPEPKIRTLDYLVNATTLIIFTCSAQHASVNFPQASLMTFVPNMPLAGFNEG

PTAEKASEADYFSLLPPLSLAEQQLDLGYTLGSVYYTQLGYYKANDVDLGDINNHTYFNDLQVKQALLSFQQRLEEIE

LIIQDRNETRPTYYDILLPSKIPQSTNI

Coding sequence for WP_103139451.1

SEQ ID NO: 223

ATGACAAATAGTCTAACTAGTGCCACAACTAATTCCAATCTAGAATCAGCTAGAGAGCAATATAAGTATAACT

ACAGCTACATTCCGCCGATCGCAATGGTGGATGAACTACCAGATGGGGAAGATTTCTCCCGTCAATGGTTGCT

GTTGCTGGCTAAAGAGTTAAAAGTAATTTTTGTGAATATTTTGATTACCAATAGAGGTAATCGAGGTTCGCAA

AAGATTCGTGATGATGTCAGAAATTTTATTCTAGAAGTTATTCTCAAAGGTGCTATACCAGCTAACATCAGTGT

AATTGCTCGATTTATGCAAATTGTCCCCCAATTGTTAATTCGGGGGTTTTCTACGGATTTTCACGAACTGGACG

ATCTGTTATTTTCGCTAATTAAAGAAAGTGGGCTTTTAATTCTGAGTGATTCCTTCCAACGAATTACTAAACTCC

TCGACAAAGGAAAACCCACAGGCCATGTGAGTAGTTTGGCGGACTATCAAAAGTTGTTTCCCGTAATTCCCCC

GCCAAAGATTGCTAAAACTTTCCAAAATGATGCTGAATTTGCCTATATGCGGGTTGCTGGCTACAATCCGGTG

ATGATTCAGCGAGTTAGTGAGTTAGATGAACGCTTCCCCGTTACCGATGCACAATATCAAGCCGTCATGGGTA

GTGATGATTCCCTTGCCCTGGCTGGTCAAGAAGGTAGACTTTATCTAGCTGACTATGGCATTTTCAACGGTGG

ACTCAATGGTTCATGTCCCAGCTATCAAAAGTATCTCTATGCACCTTTAGCACTGTTTGCAGTTCCTCCAGGCTC

AAACCCCAATCGTCTATTACAGCCAGTGGCGATTCAATGCGGTCAAAACCCCAAGGAAAATCCCATCATCACG

CCAAAATCTAGTGAATATGCTTGGTTAATTGCTAAAGCCATCGTCCAGATTGCTGATGCTAACTTTCACGAACC

AATTACCCACCTTGCCAGAACACATTTATTAGCGGGGATTTTTGCGATCGCTACCCATCGTCAACTCCCCAATTC

TCATCCCCTCTACGTGCTTCTCACGCCCCATTTTGAAGGCACTTTAGCCATTAATGATGCCGCCCAACGCGCCCT

AATTGCACCTTTGGGTGGGGTAGATATTTTGCTTTCATCTACTATTGATAACTCTCGTGTCTTAACTGTGCTAGG

TCTGCAAAGCTATGGCTTTAATCATGCCATGTTGCCGAAACAATTCCAGCAACGGGGTGTAGATGATGCCAAT

CTTTTACCTGTATATCCTTATCGGGATGATGGTTTATTACTGTGGGATGCAATTCATCAATGGGTTGCCGATTA

CATTCAAATTTACTACCACACAGACCAAGAAATTCAAGCCGACGCATATATTCAAGCTTGGGCAAAAGAGGTA

CAGGCTTATGATGGTGGTCGCCTCACAGAGTTTGGTGAAGATGGCAAAATTCAGACCAGGGAATATTTAATTG

ATGCCGTCACCTTAATTATTTTTACCGCCAGCGTCCAACACGCCGCCGTCAACTTTCCCCAAAAAGATGTCATG

GGTTATACTCCAGCCGTACCCTTAGCAGGTTATTTACCCGCCTCCATTCTTCAAGGGGAAGTTACAGAAAAAGA

-continued

CTATCTCAACTTTTTACCACCATTAGACCAAGCCCAACAGCAATATAATCTACTCGCCTTACTAGGTTCTGTTTA

TTACAACAGACTAGGGGAATACCCGCCCCAACATTTTGCTGATCCTAAAGTCGAACCCTTATTGCGATCGTTCC

AAAAGAACTTACAAGAGATCGAAACCATCATCCAAAAGCGTAACAGCGATCGCCCACCCTACGAATATCTCCT

ACCCTCAAAAATTCCTCAAAGCATCAATATCTAA

Amino acid Sequence for WP_103139451.1

SEQ ID NO: 224

MTNSLTSATTNSNLESAREQYKYNYSYIPPIAMVDELPDGEDFSRQWLLLLAKELKVIFVNILITNRGNRGSQKIRDD

VRNFILEVILKGAIPANISVIARFMQIVPQLLIRGFSTDFHELDDLLFSLIKESGLLILSDSFQRITKLLDKGKPTGHVSSLA

DYQKLFPVIPPPKIAKTFQNDAEFAYMRVAGYNPVMIQRVSELDERFPVTDAQYQAVMGSDDSLALAGQEGRLYL

ADYGIFNGGLNGSCPSYQKYLYAPLALFAVPPGSNPNRLLQPVAIQCGQNPKENPIITPKSSEYAWLIAKAIVQIADA

NFHEPITHLARTHLLAGIFAIATHRQLPNSHPLYVLLTPHFEGTLAINDAAQRALIAPLGGVDILLSSTIDNSRVLTVLG

LQSYGFNHAMLPKQFQQRGVDDANLLPVYPYRDDGLLLWDAIHQWVADYIQIYYHTDQEIQADAYIQAWAKEV

QAYDGGRLTEFGEDGKIQTREYLIDAVTLIIFTASVQHAAVNFPQKDVMGYTPAVPLAGYLPASILQGEVTEKDYLN

FLPPLDQAQQQYNLLALLGSVYYNRLGEYPPQHFADPKVEPLLRSFQKNLQEIETIIQKRNSDRPPYEYLLPSKIPQSI

NI

Coding sequence for WP_075890025.1

SEQ ID NO: 225

ATGACCGCAACATCAGGCTCCCAAAATCTAGGCTTAATCGAAAAGCAAGAAAAGTATAAGTATAACTATAGTC

ACATTCCTCCAGTGGCAATGGTCGATACCTTGCCGGAAAGCGAAAAATGGTCAATACCTTGGAAGTTGATGGT

GGCGAAGGTGGGTTATCAGCTTTTGGTTAATAAAATAATTGTGACTTATGGTGATCAAGGGAAGGCTGGTGC

AGCGAATGATGTACGGGCTTTTTTGATTGCTAGGTTAAAGGAAACTTTTGGGGAACAGAAAGGGTTGTCCAA

AGTGCGTGTCTTGCTGCAAGGTGCGAGGTTTCTGCCTCGAATTATTTGGGGTGAAATTACGACGGATGTTGTG

GATGTTGAAGAGGTGATGCGGGATGCTATTAAAACTGTTAGTAGAGATTTTCTAGAGGATTTTGCTGCAAATG

TGATGGAGCAACTTACCGTTGACGGTAAGGATGGTCGTTGTCTATCGAGTACAGATTTTGAGAGGCTTTTTGC

CACGATTGATTTACCGGAGATTGCTTATGAGTATCAAACGGATGAAAGTTTTGCTTATATGAGGGTGGCGGGA

CCTAATGCGGTTATGCTCGAAAAAATCACGGAACCTGATCCTCGTTTTCCTGTGACGGAGGCTCATTATCAAGC

GGTGATGGGAGAGGGGGATTCTCTTGCTGCGGCAAGGGCGGAGGGTCGATTATTTTTGTGTGATTATGAGAT

TTTGGATGGTGCGGTTAATGGTTCTTTTCCGACGGATCAGAAATATCTTTATGCGCCGTTAGCGTTGTTTGCTG

TACCAAAGGCAGATGCTGGGAAACGTGATTTGAGGCCTGTTGCGATTCAGTTGGGTCAAAAACCGAAGGAGT

ATCCGATTCTCACGCCGAAGTCTAATCGGTATGCTTGGCTCTGTGCGAAAACGGCGGTACAGGTTGCGGATGC

GAATTTCCATGAGGCGGTTACTCATTTAGGGCGGACTCATTTGTTTATGGGGCCGTTTGTGATCGCCACCCATA

GACAATTGCCAGAAAATCATCCTTTGTTTAAATTACTAACGCCCCATTTTTTAGGGATGTTGGCGATCAATGAT

TCTGCGCAGGCGAAATTGATTTACAAGGGGGGTGGTGTTGATAAAATTTTGGCGACAACTATTGATAATGCCC

GTTTGTTTGCGGTGCTGGGTGTGCAAACCTATGGTTTTAATCGTGCTATGTTGCCGGATCAATTGGCTGCGCG

CGGTGTTGATGATACGGAGGCATTACCGGTTTATCCCTATCGTGATGATGCTTTATTGATTTGGGAGGCGATTT

ATAACTGGGTTAAGGCTTACTTGAAGACTTATTATCCGGGCGATAGTGCTGTGCAGCGTGATCAGGCGCTACA

AGCTTGGGCAAAGGAACTCATTTCCTATAAGGGTGGGCGAGTGGTGGACTTTGGTGAAGATGGTGATATCAA

AACGTTGTCGTACCTGATCGATGCAGTGACGCTCATTATTTTTACGGTGAGTGCCCAACATGCGGCGGTAAAT

TTTCCGCAGAAGGGTTTGATGAGTTTTGCGCCGGGTATGCCGACTGCGGGCTATGCTCCCCTTGATAATCTGG

GTGATCAGACGGCAGAACAGGATTATCTTGATTTGCTGCCGCCAATTTCTCAGGCTCAGGAGCAATTAAAACT

-continued

GTGTCATTTACTTGGGTCTGTTCACTTCACGCAGTTAGGGCAGTATGACAAAAAGCATCTTGGTGACCCGAAA

ATTCAAAAGCCGCTGCGGCAATTTCAAGGGCGACTCGAGGAAATTGAGATGATTATCCACAAGCGTAATGGC

GATCGCCCAACCTATGAATATTTACTCCCTAGTCTTATTCCCCAGAGTATCAATATCTAA

Amino acid Sequence for WP_075890025.1

SEQ ID NO: 226

MTATSGSQNLGLIEKQEKYKYNYSHIPPVAMVDTLPESEKWSIPWKLMVAKVGYQLLVNKIIVTYGDQGKAGAAN

DVRAFLIARLKETFGEQKGLSKVRVLLQGARFLPRIIWGEITTDVVDVEEVMRDAIKTVSRDFLEDFAANVMEQLTV

DGKDGRCLSSTDFERLFATIDLPEIAYEYQTDESFAYMRVAGPNAVMLEKITEPDPRFPVTEAHYQAVMGEGDSLA

AARAEGRLFLCDYEILDGAVNGSFPTDQKYLYAPLALFAVPKADAGKRDLRPVAIQLGQKPKEYPILTPKSNRYAWL

CAKTAVQVADANFHEAVTHLGRTHLFMGPFVIATHRQLPENHPLFKLLTPHFLGMLAINDSAQAKLIYKGGGVDKI

LATTIDNARLFAVLGVQTYGFNRAMLPDQLAARGVDDTEALPVYPYRDDALLIWEAIYNWVKAYLKTYYPGDSAV

QRDQALQAWAKELISYKGGRVVDFGEDGDIKTLSYLIDAVTLIIFTVSAQHAAVNFPQKGLMSFAPGMPTAGYAPL

DNLGDQTAEQDYLDLLPPISQAQEQLKLCHLLGSVHFTQLGQYDKKHLGDPKIQKPLRQFQGRLEEIEMIIHKRNG

DRPTYEYLLPSLIPQSINI

Coding sequence for WP_050046589.1

SEQ ID NO: 227

ATGCGTTCGCGTAGCGGCTGCTTTGCAGCATCGCCAAACCGACAACAAAGACACCAACAATTAATCGAGCAGT

ACGTTTTCTCGCGCCGTACCATGCTAGCGCTCCTTGGTTTCATTTGTGCTCCAGGCTTGGAACATTTTATAGTAA

GTGACACTCAACCAAGAGAACCCACGCTTCCTGCCAATCCTCAAATCCCAACTTTACCTCAAAAAAATTCATTG

GCATCCCAAAAAGAACGCCAACAGCAGCTTGAGATTGCACGCTCTAAATACCAGCTAACACCTCGACTGCCAA

ACTCTGTTAGGGTATCAACTTTACCGATCGAAGAGGCTTTTGATGGGGGCTATAGCAGTAATCGGGCAAGCAT

AACCCGGAAAATTACAGAAAATCAACAAGCATTTTTCCAAAATCCCAAACCTTTTCTCGCATTAGAAGACTACA

CAAATGTTTTTCAAGTTTTACCCGTACCGGATATTGCTAAAACCTTTCGCAAGGATGCGATATTTGCAGGGCAA

CGGCTGTGGGGTCCCAATCCCATGGAACTTACCAACGTTCTAGCACTCAATTACGATCTTCAAGAAAAACTGG

GAATAACAAATGAGATTTTTCAAACCGTTTTGGGTGCTGCTAGAGGAACGGCATATGTTAGCGAAACTCTTGA

AAGTGCTACTAAAAATGGCGGTCTGTTTGTAACGGATTATGCAATCCTTGCGACTGATGGCATTACCTCAAAA

ACAAAGCGATATCTCATTGCTCCTATCGCTCTTTATTACGCCGATCGCGACCGTGGTAATTGGCGTTTAATTCCC

ATTGCCATTCAACTCGGACAAGTTCCTCAAGAAAGTTTGCTTTGTACTCCCTTGGATGGAGTGGATTGGACTCT

AGCCAAGCTCATCGCTCAAATGGCTGATTTTTCCGTTCATGAATTGGTCCGTCACTTGGGTCAAACCCATCTTG

CTCTAGAACCCATCGCACTGGCAACTGTACGCGAACTCCCTGCCCTTCATCCCGTACACGTCCTATTAAAACCC

CATTTTGAGTTCACAATGGCAATCAATGCTTTTGGCGATCGAGTGTTGATTAATCCAGGGGGATACGTAGATG

TCATTCTAGGAGGTACTTTAGAAAGCTCCCTCAACCTTGTAAATCTTGGTGTCTCGGAAATGTTCGATAACTTC

AGCAACTTTGCTTTGCCGAACAATTTACAAAGGCGCGGTGTTGGCGATCGCTCTTTATTAAAAGATTTTCCCTA

TCGAGATGACGGAGTGCTGGTTTGGGATGCTCTATCCGAGTATGTCAGTCGGTATGTAGGAATTTACTACAGA

TCTTCTAAAGATATTCGAGAGGATTTCGAGTTACAAAATTGGTTAAAAGCTTTACGGACACCTGTTAGTGATG

GAGGTTTTGGTGTCACTTCTTTACCATCCTACCTAAAAGACCGCGACCAGTTAATTGACCTGCTAACACAAATT

ATTTTTACAGCAGGTCCGCAACACTCAGCCATTGCCTGGACTCAATATCAGTATATGTCTTTTGTCCCTAATATG

CCTGGAGCTATTTATCAGCCTGTTCCTATTACCAAGGGAACAATTGAAGATGAGAAGAGTTTAACAAGTTTTCT

TCCTGGTATAGAACCAACTTTTGCACAAGTTAACGTCATATCGGGAATTGGTGTCAAACTTGATGTCAAAGCAT

TTACAGATTTTGGTGTCAATAGTTTTCAAGATCCGCGAGCTATTGCTGTTCTTAAAGGCTTGCAAAATCGTTTG

GAGGTTGTAGAAAAACAGATCGAACAACGAAATAAACGCCGAGAGGAATGCTACCCTGGCTTTTTACCTTCTC

GTATGGCTAACAGTACCAGTGGTTGA

-continued

Amino acid Sequence for WP_050046589.1

SEQ ID NO: 228

MRSRSGCFAASPNRQQRHQQLIEQYVFSRRTMLALLGFICAPGLEHFIVSDTQPREPTLPANPQIPTLPQKNSLASQ

KERQQQLEIARSKYQLTPRLPNSVRVSTLPIEEAFDGGYSSNRASITRKITENQQAFFQNPKPFLALEDYTNVFQVLP

VPDIAKTFRKDAIFAGQRLWGPNPMELTNVLALNYDLQEKLGITNEIFQTVLGAARGTAYVSETLESATKNGGLFVT

DYAILATDGITSKTKRYLIAPIALYYADRDRGNWRLIPIAIQLGQVPQESLLCTPLDGVDWTLAKLIAQMADFSVHEL

VRHLGQTHLALEPIALATVRELPALHPVHVLLKPHFEFTMAINAFGDRVLINPGGYVDVILGGTLESSLNLVNLGVSE

MFDNFSNFALPNNLQRRGVGDRSLLKDFPYRDDGVLVWDALSEYVSRYVGIYYRSSKDIREDFELQNWLKALRTPV

SDGGFGVTSLPSYLKDRDQLIDLLTQIIFTAGPQHSAIAWTQYQYMSFVPNMPGAIYQPVPITKGTIEDEKSLTSFLP

GIEPTFAQVNVISGIGVKLDVKAFTDFGVNSFQDPRAIAVLKGLQNRLEVVEKQIEQRNKRREECYPGFLPSRMANS

TSG

Coding sequence for WP_012163949.1

SEQ ID NO: 229

ATGACGCATCAGTACTCCCTCACTGGCCTGCCGACCCAAATCACACCTGTAGAAATTCAACAGGACAAACATC

AACCCACTCTGGCCCCCACTCGTCCTAATCCGACCCAGCCGGAGCCTATCCCCGCAGCGCTAAAAGCAGCTCG

ACGCAAATATCAATACAACTATAGTCACATTGCCCCTGTGGCCATGGTGGATCGCTTACCCAAAGAGGAACTC

CCCTCTAGGGCTTGGTGGTCAAAGTTGATCCGTACCATGTTCAAGATTCTCTCGAATGCCATTGTTGGCGCCCA

TAATCACCACCATGAGCATGAAGCAGAGCAGCATGCTTCTCGCCTCATTCGCAAAACCTTGGTGGATATCTTG

AGACAACGCCCCGAGGTGCGGTGGCGTCTCATCTGGCATCTGCTGAAAACAGCGCCAACGACTTTGCTTAACG

GTTTACGGTTGTCGTTTTCTGATGCCGAAAGCTTGCTGCACAGTTTAGCCGCCCATTTAGAGCATGATCTATTA

CGGATTCTGCACTTGAACTTAAAAGAACATCTAGCCCATGAATGTGGACAAGATCGCCCTACCTCAATAGCAG

ACTTTAATCAGCAGTTTGCAACGATTCCGTTACCGGAGTGTGCCGAATACTTTCAAGAAGATGAGTTTTTTGCT

TACTTGCGAGTAGCCGGTCCTAATCCTGTTTTGCTGCAACAAGTCCGCCATTTATCGGGAGACATCCTCTGCTC

TCATTTCCCAGTTACCAATCAGCATTATCAGACCGTAATGGGAGAAGACGATTCTCTGCAAATAGCAATCACCG

AAGGCCGTCTATACATCGCCGATTATGCTATTTTGGCTGGTGCGATCAATGGTAACTACCCCGATCAGCAAAA

ATATATTTCGGCTCCCATCGCCCTTTTTGCCGTTCCCTCAGCTGATGCCCCCTGCCGAAATCTCCAGCCCATCGC

TATTCAATGCCGCCAATCTCCAGGGCCTGAAACACCGATTCTGACGCCGCCTACGGATCAGAATCCAGACCAA

AAACAGGCCTGGGACATGGCGAAGACCTGCGTGCAAGTTGCAGACAGCAATTACCATGAGGCCGTCACCCAT

TTGGGTCGAACCCATCTGTTTATTAGCCCGTTTGTAATTGCCACCCATCGCCAACTACTGCCGTCTCATCCCGTG

AGTGTCCTGCTTCGGCCTCACTTTGAAGGCACCTTAAGTATCAACAACGGTGCTCAAAGCATGTTAATGGCGC

CAGAAGGTGGAGTGGATACGGTCTTGGCTGCCACTATCGACTGTGCCAGGGTCTTAGCCGTAAAGGGAGTAC

AAAGCTATTCCTTTAATCAGGCCATGCTGCCCCAACAATTGCGGCAACTGGGTTTGGATAATGCAGAGGCGCT

TCCCATCCACCCCTATCGAGACGATGCATTGCTGATTTGGCAGGCCATCGAAACTTGGGTCACTGATTATGTGA

GCTTGTACTACCCAACAGATGACTCCGTGCAAACAGATGCGGCCCTTCAGGCTTGGGCGCAGGAGCTACAGG

CTGAAGAGGGTGGCCGAGTCCCAGATTTTGGTGAGGATGGACAATTGCGAACCCAGGCCTACTTGATTCAAG

CCCTCACGCTGATCATCTTTACCGCGAGTGCCCAACATGCCGCTGTGAATTTTCCCCAGGGCGACATCATGGTC

TATACCCCAGGGATGCCATTAGCAGGCTACCAGCCCGCTCCCAACTCGACAGCTATGTCTTCCCAGGATCGGC

TCAACCAACTGCCCTCCTTACACCAGGCCTTAAATCAGCTGGAGTTAACGTATTTGCTCGGGCAGATTTACCAT

ACGCAACTCGGTCAATACGAAAAGTCTTGGTTCTCTGATCAGCGAGTGCAAGCTCCGCTGCATCGGTTTCAAG

CCAATTTACTGGATATCGAAACTGCGATCGCAGAACGAAACCGCCATCGCCCCTACCCTTACCGCTACCTACAG

CCGTCCAACATTCCCCAGAGCATCAATATCTAA

-continued

Amino acid Sequence for WP_012163949.1

SEQ ID NO: 230

MTHQYSLTGLPTQITPVEIQQDKHQPTLAPTRPNPTQPEPIPAALKAARRKYQYNYSHIAPVAMVDRLPKEELPSRA
WWSKLIRTMFKILSNAIVGAHNHHHEHEAEQHASRLIRKTLVDILRQRPEVRWRLIWHLLKTAPTTLLNGLRLSFSD
AESLLHSLAAHLEHDLLRILHLNLKEHLAHECGQDRPTSIADFNQQFATIPLPECAEYFQEDEFFAYLRVAGPNPVLL
QQVRHLSGDILCSHFPVTNQHYQTVMGEDDSLQIAITEGRLYIADYAILAGAINGNYPDQQKYISAPIALFAVPSAD
APCRNLQPIAIQCRQSPGPETPILTPPTDQNPDQKQAWDMAKTCVQVADSNYHEAVTHLGRTHLFISPFVIATHR
QLLPSHPVSVLLRPHFEGTLSINNGAQSMLMAPEGGVDTVLAATIDCARVLAVKGVQSYSFNQAMLPQQLRQLGL
DNAEALPIHPYRDDALLIWQAIETWVTDYVSLYYPTDDSVQTDAALQAWAQELQAEEGGRVPDFGEDGQLRTQA
YLIQALTLIIFTASAQHAAVNFPQGDIMVYTPGMPLAGYQPAPNSTAMSSQDRLNQLPSLHQALNQLELTYLLGQI
YHTQLGQYEKSWFSDQRVQAPLHRFQANLLDIETAIAERNRHRPYPYRYLQPSNIPQSINI

Coding sequence for WP_050046033.1

SEQ ID NO: 231

ATGCGTTCGCGTAGCGGCTGCTTTGCAGCATCGCCAAACCGACAACAAAGACACCAACAATTAATCGAGCAGT
ACGTTTTCTCGCGCCGTACCATGCTAGCGCTCCTTGGTTTCGTTTGTGCTCCAGGCTTGGAACATTTCATAGTG
GGTGACACTCAACCAAGAGAACCCAAGCTTCCTGCCAATCCTCAAATCCCAACTTTACCTCAAAAAAATTCATT
GGCATCCCAAAAAGAACGCCAACAGCAGCTTGAGATTGCACGCTCTGAATACCAGCTAACATCTCGATTGCCA
AACTCTGTTAGGGTGTCAACTTTACCAATCAAAGAGGCTTTTGATGGGGGCTATAGCAATAATCGGGCAAGCA
TAACCCAGAAAATTACAGAAAATCAACAAGCATTTTTCCAAAATCCCAAACCTTTTCTCGCATTAGAAGACTAC
ACGAATGTTTTTCAAGTTTTACCCGTACCGGATATTGCCAAAACCTTTCGCAAGGATGTGATATTTGCAGGGCA
ACGGCTGTGGGGTCCCAATCCCATGGAACTTACCAACGTTTTAGCACTCAATTACGATCTTCAAGAAAAACTG
GGGATAACAAATGAGATTTTTCAAACCGTTCTAGGTGCTGCTAGAGGAACGGCATACGTTAGCGAAACTCTTG
AAAGTGCTACCAAAAATGGTGGTCTGTTTGTAACTGATTATGCAATCCTTGCGACTGATGGCATTACTTCAAAA
ACAAACCGATATCTCATTGCTCCTATCGCTCTTTATTACGCCGATCGCAACCGTGGTAATTGGCGTTTAATTCCC
ATTGCCATTCAACTCGGGCAAGTTCCTCAAGAAAGTTTGCTTTGTACTCCCTTGGATGGAGTAGATTGGACTCT
AGCCAAGCTCATCGCTCAAATGGCTGATTTTTCCGTTCATGAATTGGTCCGTCATCTGGGTCAAACCCATCTTG
CTCTAGAACCCATTGCACTGGCGACTGTACGCGAACTCCCTGCCCTTCATCCAGTGAACGTCCTATTAAAACCC
CATTTTGAGTTCACAATGGCCATCAATGCTTTTGGCGATCGGGTGTTGATTAACCCAGGGGGATACGTAGATG
TCATTCTGGGAGGTACTTTAGAAAGCTCCCTCAAGCTGACTAACCTTGGTGTCTCGGAGATGTTCGATAACTTC
AGCAACTTTGCTCTGCCGAACAATTTACAAAGGCGCGGTGTTGGCGATCGCTCTTTATTAAAAGATTTTCCCTA
TCGAGATGACGGAGTGTTGGTTTGGGATGCTCTATCCGAGTATGTCAGTCGGTACGTAGGAATTTACTACAAA
TCTTCTAAAGATATTCGAGAGGATTTCGAGTTACAAAATTGGTTAAAAGCTTTACGGACACCTGTTAGTGATG
GAGGTTTTGGTGTCACTTCTTTACCATCCTACCTACAAGACCGCGACCAGTTAATTGACCTGCTAACACAAATT
ATTTTTACAGCAGGTCCGCAACACTCAGCCATTGCTTGGACTCAATATCAGTATATGTCTTTTGTTCCTAATATG
CCTGGAGCTATTTATCAGCCTGTTCCTATTACCAAGGGAACAATTGAAGATGAGAAGAGTTTGACAAGTTTTCT
TCCTGGTATAGAACCAACTTTTGCACAAGTTAACGTCATATCGGGAATTGGTGTCAAACTTGATATCAAAGCAT
TTACAGATTTCGGTGTCAATAGTTTTCAAGATCCGCGAGCTATTGCTGTTCTTAAAGGCTTGCAAAATCGTTTG
GATGTTGTAGAAAAACAGATCGAACAACGCAATAAACGCCGAGAGGAATGCTACCCTGGCTTTTTACCTTCTC
GTATGGCTAACAGTACCAGTGGTTGA

Amino acid Sequence for WP_050046033.1

SEQ ID NO: 232

MRSRSGCFAASPNRQQRHQQLIEQYVFSRRTMLALLGFVCAPGLEHFIVGDTQPREPKLPANPQIPTLPQKNSLAS
QKERQQQLEIARSEYQLTSRLPNSVRVSTLPIKEAFDGGYSNNRASITQKITENQQAFFQNPKPFLALEDYTNVFQVL

-continued

PVPDIAKTFRKDVIFAGQRLWGPNPMELTNVLALNYDLQEKLGITNEIFQTVLGAARGTAYVSETLESATKNGGLFV

TDYAILATDGITSKTNRYLIAPIALYYADRNRGNWRLIPIAIQLGQVPQESLLCTPLDGVDWTLAKLIAQMADFSVHE

LVRHLGQTHLALEPIALATVRELPALHPVNVLLKPHFEFTMAINAFGDRVLINPGGYVDVILGGTLESSLKLTNLGVSE

MFDNFSNFALPNNLQRRGVGDRSLLKDFPYRDDGVLVWDALSEYVSRYVGIYYKSSKDIREDFELQNWLKALRTPV

SDGGFGVTSLPSYLQDRDQLIDLLTQIIFTAGPQHSAIAWTQYQYMSFVPNMPGAIYQPVPITKGTIEDEKSLTSFLP

GIEPTFAQVNVISGIGVKLDIKAFTDFGVNSFQDPRAIAVLKGLQNRLDVVEKQIEQRNKRREECYPGFLPSRMANS

TSG

Coding sequence for WP_096660823.1

SEQ ID NO: 233

ATGACTGATTTATCGCAAAATAATTCGACATCAGTTGATAAATTAAAACTTGCTAGGCAAGAATACCAGTACA

GCTATATCCATATTCCACCTATTGCTATGGTAGATAAACTTCCTAGTAACGAGAATTTCTCTACTGGTTGGCTGC

GTTTATTAGCTAGAGAATTAAAAGTTGTTTTTATCAATACCCTAATTGCAAATCGAGGAAATCGCGGTTCGGAA

AATGTTCGCGACGATGTGAGATTATTTTTCCTGGAAGTATTAGCGAAAGGAGCATTACCCTTTAATTTAGGTGT

TACTGCTAGAGTTTTACAAATTATTCCTAATCTATTACTTAAAGGAACATCAAAAGATTTTAGCGAAATCGATG

ATTTATTCTTTTCTATACTTAAGGAAAGCGGACTGTCAATTTTTCAAGATTCTTTGAGTCGAGTTAAAAGTCTTT

TGTATGAAAAACGTCCGACGGGACATGTAAGCAGCTTGAATGATTATCAAAAACTTTTCCCTGAAATGGAAAT

ACCCAAGATAGCTGATAATTTCTCTACAGACGAACAATTTGCTTATATGCGGGTAGCTGGATATAACCCGGTA

ATGATTGAGCGAGTGAATAAATTGGGCGATCGCTTTCCTGTTACCGAAGCTCAATATCAGGAAGTCATGGGA

GATGATTCTTTAACAGCAGCGGGTGAGGAAGGAAGACTTTATTTAGCTGATTATGGAATTTTAGAAGGTGCTG

TTAACGGTACTTTTCCTTCACAGCAAAAGTATATCTATGCTCCGCTAGCACTATTTGCAATTCCTAAAAATTCCG

AGAATGACGAATCGAGTTTAATGCGTCCGGTTGCGATTCAGTGCGGTCAAAACCCCCAGAATAATCCTATTTG

TACGCCAAAATCAGACAAATATGCTTGGCTGTTTGCAAAAACTATTGTTCAAATCGCAGATGCTAACTACCACG

AAGCTGTAACTCATTTAGGACGTACTCATTTGCTTGTAGGTCCCTTTGTTGTTGCAACTCATCGTCAGTTACCGG

ATAGTCATCCGCTTAATATATTATTGCGTCCTCATTTTGAAGGGACTTTAGCAATAAACAATGCAGCCCAAAGT

AGTTTGATTGCTGCTGGTGGGGGTGTGGATAAATTACTTGCATCGACTATTGATAATTCCCGTGTTTTGGCAGC

AGTTGGTTTACAAAGCTATGGGTTCAATGAAGCAATGTTACCCAAGCAATTAGAAAAACGCGGGGTTAACGA

TACACAAAAGCTACCTATTTACCCATACCGCGATGATGCTCTATTAATTTGGAATGCTATACATACATGGGTTG

CAGATTATCTAAGCATTTATTATAAGGACGATACCAGCATTCAAAATGATACCTATCTCCAAAATTGGGCTATT

GAAGCAGGGGCTTACGATGGTGGACGCGTTCCTGATTTTGGTCAAGAAAATGGGCTGATTCAAACCTTGGAC

TATCTAATTGATGCTACTACACTGATTATTTTTACTGCTAGCGCTCAACATGCTGCGGTTAATTTCCCCCAGGGA

GACATGATGATCTACGCGGCCGCAGTACCTTTAGCTGGTTATCAACCTGCTTCAATTCTCGAAGGAAAAGTTAC

TCAGGAAGACTACTTAAATTTACTTCCACCTCTAGAGCAAGCACAAGAACAATTGAATTTAGTCTATTTATTAG

GTTCTATTTACTATAAAACTTTGGGTGATTACTCAGATAATTACTTCAAAGATGCTTTAGTCAAACCAGCTTTAC

AAGAATTCCGAAATAATTTACTCGAAGCTGAAGCTACTATCCATCAACGCAATCAAAATCGTCCGACTTACGAA

TATTTGCTGCCTTCAAAAATTCCACAGAGTATCAATATTTAG

Amino acid Sequence for WP_096660823.1

SEQ ID NO: 234

MTDLSQNNSTSVDKLKLARQEYQYSYIHIPPIAMVDKLPSNENFSTGWLRLLARELKVVFINTLIANRGNRGSENVR

DDVRLFFLEVLAKGALPFNLGVTARVLQIIPNLLLKGTSKDFSEIDDLFFSILKESGLSIFQDSLSRVKSLLYEKRPTGHVS

SLNDYQKLFPEMEIPKIADNFSTDEQFAYMRVAGYNPVMIERVNKLGDRFPVTEAQYQEVMGDDSLTAAGEEGR

LYLADYGILEGAVNGTFPSQQKYIYAPLALFAIPKNSENDESSLMRPVAIQCGQNPQNNPICTPKSDKYAWLFAKTIV

QIADANYHEAVTHLGRTHLLVGPFVVATHRQLPDSHPLNILLRPHFEGTLAINNAAQSSLIAAGGGVDKLLASTIDN

SRVLAAVGLQSYGFNEAMLPKQLEKRGVNDTQKLPIYPYRDDALLIWNAIHTWVADYLSIYYKDDTSIQNDTYLQN

-continued

WAIEAGAYDGGRVPDFGQENGLIQTLDYLIDATTLIIFTASAQHAAVNFPQGDMMIYAAAVPLAGYQPASILEGKV

TQEDYLNLLPPLEQAQEQLNLVYLLGSIYYKTLGDYSDNYFKDALVKPALQEFRNNLLEAEATIHQRNQNRPTYEYLL

PSKIPQSINI

Coding sequence for WP_110989156.1

SEQ ID NO: 235

ATGACAGACTCTAATACTGCTCAAGAAGCTCAGTCTCAGCAATACGAGTATCGGTACGACGCCTTTAAAAATA

TTTCACCTAAGTTGATATATCCAATGGCAGTGAAAGTCTTACCTGCTGATCAGTCGTTTACGAAATGGAAGTGG

ACGAAAAATGTAGTTTCCCTTGTACTTAGACTAGTTGCAAATCAGGCCATGCAAAATGTATCACTCCGAAAGG

GATCGGCCTGCCGCCTGATTACATTTATCCGCTTATACAGAATTTTAGAAGATCCAAAGAACAGTTCCTATATT

GAAAGACTCTTTGATTTCATCATTAGCATTGCCCGAGCGTTGACAAATCGGTTCAAGCGCAGACCTAAATCTCA

AGATATTGAACAAGATGTTAAGCAAAACCAGAAGCCCGATCAGGTGCAAGCCAGGGTTGAGGCAATGGTTGA

TGATATTCAACAGCAATCTAAAACGAAGGACCCGGTAAAGCATCTTTCATTTGAGGACTATCGCAATCTATTTC

AGATCATCTATTTACCGGATATTAGCAATCATTTTCTTGAGGATCGCTCCTTTGCAGCTCAACGGGTGGCGGGG

GCTAACCCACTGGTCATTATGCAAGTCTCTGAACTCCCTGAGTATTTCAAGGTAACTGAGGAACACTATACAAA

GGTGATGGGTAAAGATGACTCCCTTCAGGCTGCACTAGACGAGGGGCGGATCTACCTGGCTGACTACAAGAT

TCTGGACGAAATCGATCCAGGGACTGTTGAGGTAGGGGTAAACGGTAGCATCAAAGAAACGATTGAGAAATT

CGGTTATGCACCTCTAGCTTTGTTTGCGATCGCCTCGGGTGATTGTCCGGGCCGTCTACTGACACCGGTTGCGA

TTCAATGCAGTCAAGACGCTGGCAGTCTCATTTTTACTCCACCCAGTATAGCGGCTGTTGATGAGGAGCGATG

GGCTTGGAGAATGGCAAAGACGGTCGTTCAGGTCGCTGATGGCAATTACCATGAACTAATCTCACACCTAGG

ACGCACTCATCTGTGGATTGAGCCAATAGCGCTCGGTACCTACCGTCGTTTAGCAAAACACAAGTTAGGTAAG

CTCCTTCTGCCTCATTTTGAGGGTACTTTCTTCATCAATAATGCTGCTGCAGGTAGCCTGATTGCTAAGGGTGG

TGTTGTGGAAAGTATTTTATCGGGTACGTTGCTATCGTCTGTAACGCTCAGTGTTAAGGCTGCGAAGGGATAC

CCGTTTGCATTTAATGATTCAATGCTTCCCAAAACCTTTGCTGCTCGTGGTGTAGATGATCCACAAAAATTACC

GGACTACCCCTATCGTGATGATGCGTTGCTCATTTGGGATGCCATTCATAAGTGGGTTAAGTCATACCTTGAG

GTCTACTACAGCAGTGATGATGAGGTGCTAAGTGATGCCGTTTTACAGGCGTGGCTAGCAGAACTTGTCGCTG

AGGATGGGGGCCAGATGACAGAGATAGGAGAAGTCATACCAGAGGACAGAAGACCAAAAATCCGAACGTTG

GATTATTTGATCGATGCGACAACGCTGATTATCTTCACTTGTAGCGTTCAACATGCAGCAGTCAATTTCACCCA

AGCATCGTTAATGTCGTTTGCACCCAATATGCCACTGGCAGGATTTAATGCGGCTCCAACGACTCTTAAAGTCA

GTGAAGCAGACTACTTTTCGATGCTGCCATCACTTAGCCTAGCTGAGCAACAAATGAATTTTGGATATACATTA

GGATCCGTGTACTACACTCAAATCGGACAATACAAGGCTAATGAGGTAGAGCTAGAGGAGATGAATCAGCAT

GATTACTTTGGTGATTCACGAATCTCTCATCACCTAGAGATTTTTCAGAACAAGTTGAAAGAGATTGAGTTGAC

CATTCAACAACGGAACGAAACTCGTCCTACTTTTTACGATATTTTGCTGCCGTCAAAAATTCCGCAATCTACAA

ATATCTAG

Amino acid Sequence for WP_110989156.1

SEQ ID NO: 236

MTDSNTAQEAQSQQYEYRYDAFKNISPKLIYPMAVKVLPADQSFTKWKWTKNVVSLVLRLVANQAMQNVSLRK

GSACRLITFIRLYRILEDPKNSSYIERLFDFIISIARALTNRFKRRPKSQDIEQDVKQNQKPDQVQARVEAMVDDIQQQ

SKTKDPVKHLSFEDYRNLFQIIYLPDISNHFLEDRSFAAQRVAGANPLVIMQVSELPEYFKVTEEHYTKVMGKDDSL

QAALDEGRIYLADYKILDEIDPGTVEVGVNGSIKETIEKFGYAPLALFAIASGDCPGRLLTPVAIQCSQDAGSLIFTPPSI

AAVDEERWAWRMAKTVVQVADGNYHELISHLGRTHLWIEPIALGTYRRLAKHKLGKLLLPHFEGTFFINNAAAGSL

IAKGGVVESILSGTLLSSVTLSVKAAKGYPFAFNDSMLPKTFAARGVDDPQKLPDYPYRDDALLIWDAIHKWVKSYL

EVYYSSDDEVLSDAVLQAWLAELVAEDGGQMTEIGEVIPEDRRPKIRTLDYLIDATTLIIFTCSVQHAAVNFTQASLM

-continued

SFAPNMPLAGFNAAPTTLKVSEADYFSMLPSLSLAEQQMNFGYTLGSVYYTQIGQYKANEVELEEMNQHDYFGDS

RISHHLEIFQNKLKEIELTIQQRNETRPTFYDILLPSKIPQSTNI

Coding sequence for WP_010473598.1

SEQ ID NO: 237

ATGACGCATCAGTACTCCCTCACTGGCCTGCCGACCCAAATCACGCCTGTTGAAATTCAACAGGACAAACATCA

ACCCACTCTGACCTCCACTCGTCCTAATCCGACCCAGCCGGAGCCGATTCCCGCAGCGCTAAAAGCAGCTCGA

CGCAAATATCAATACAACTACAGTCACATTGCCCCTGTAGCCATGGTGGATCGCTTACCCCAAGAGGAACTCC

CCTCTCGGACTTGGTGGTCAAAGTTGTTCCGTACCATGTTCAAGATTCTCTCGAATGCCATTGTTGGCGCCCAC

AATCACCACCATGAGCATGAAGCAGAGCAACATATTTCCCGTCTCATTCGCAAAACCTTGGTGAATATCTTGAC

TCAACGCCCCGAGGTGCGGTGGCGTCTCATCTGGCATCTGCTGAAAACAGCACCAACGACGTTGATTAACGGT

TTACGGTTGTCGTTCGCTGATTCAGAAAGCTTGCTGCACAGTTTAGCCGCCCATTTAGAGCATGATCTATTACG

GATTCTGCACTTGAACTTAAAAGAACATCTAGCCCATGAATGTAGACAAGATCGTCCTACTTCAATAGCAGACT

TTAATCAGCAATTCGCGACAATTCCGTTACCGGAGTGTGCCGAATACTTTCAGGAAGATGAGTTTTTTGCTTAC

TTGCGAGTAGCCGGTCCTAATCCTGTTTTGCTGCAACAAGTCCGTCATTTATCGGGAGACACCCTCTGCTCTCA

TTTCCCGGTTACGAATCAGCATTATCAGGCCGTGATGGGAGCAGACGATTCTCTGCAAACAGCGGTCACCGAG

GGCCGACTATACATCGCCGATTATGCTATTTTGGCCGGTGCGATCAATGGTAACTACCCCGATCAGCAAAAAT

ATATTTCGGCTCCCATCGCCCTTTTTGCTGTTCCCTCAGCTGATGCCCCCTGCCGAAATCTCCAGCCCATCGCTA

TTCAATGCCGCCAATCTCCAGGGCCTGAAACACCGATTCTGACGCCGCCTACGGATCAGAATCCAGACCAAAA

ACAGGCCTGGGACATGGCGAAGACCTGCGTGCAAGTTGCCGATAGCAATTACCACGAGGCCGTCACCCATTT

GGGTCGAACCCATCTGTTTATTAGCCCGTTTGTAATTGCCACCCATCGCCAATTACTGCCGTCTCATCCTGTGA

GTGTCCTGCTTCGGCCTCACTTTGAAGGCACCTTAAGTATCAACAACGGCGCTCAAAGCATGTTAATGGCGCC

AGAAGGTGGAGTGGATACGGTCTTGGCTGCCACCATCGACTGTGCCAGGGTCTTAGCCGTAAAGGGATTACA

AAGCTATTCCTTTAATCAGGCCATGCTGCCCCAACAATTGCAGCAACTGGGTTTGGATAATGCAGCGGCACTG

CCCATCCATCCCTATCGAGACGATGCCTTGCTGATTTGGCAGGCCATCGAAACTTGGGTCACTGATTATGTGAG

CTTGTACTACCCAACAGATGACTCCGTGCAAAAAGATGCGGCCCTTCAGGCTTGGGCGCAGGAGCTACAGGC

TGAAGAGGGTGGCCGAGTCCCAGATTTTGGTGAGGATGGACAATTGCGAACCCAGGCCTACTTAATTCAAGC

CCTCACGCTGATCATTTTTACCGCGAGTGCCCAACATGCCGCTGTGAATTTTCCCCAGGGCGACATCATGGTCT

ATACCCCAGGGATGCCATTAGCAGGCTACCAGCCCGCTCCCAACACGACAGCGATGTCTTCCCAGGATCGGCT

CAACCAACTGCCCCCCCTACACCAGGCCTTAAATCAGCTGGAGTTAACGTATTTGCTCGGGCAGATTTACCATA

CGCAACTCGGTCAATACGAAAAGTCCTGGTTCTCTGATCAGCGTGTACTCGCGCCTCTGCATCGTTTTCAGGCC

AATTTACTGGATATCGAAACTGCGATCGCAGAACGAAACCGCCATCGCCCCTACCCTTACCGCTACCTACAGCC

GTCCAACATTCCCCAGAGCATCAATATCTAG

Amino acid Sequence for WP_010473598.1

SEQ ID NO: 238

MTHQYSLTGLPTQITPVEIQQDKHQPTLTSTRPNPTQPEPIPAALKAARRKYQYNYSHIAPVAMVDRLPQEELPSRT

WWSKLFRTMFKILSNAIVGAHNHHHEHEAEQHISRLIRKTLVNILTQRPEVRWRLIWHLLKTAPTTLINGLRLSFADS

ESLLHSLAAHLEHDLLRILHLNLKEHLAHECRQDRPTSIADFNQQFATIPLPECAEYFQEDEFFAYLRVAGPNPVLLQ

QVRHLSGDTLCSHFPVTNQHYQAVMGADDSLQTAVTEGRLYIADYAILAGAINGNYPDQQKYISAPIALFAVPSAD

APCRNLQPIAIQCRQSPGPETPILTPPTDQNPDQKQAWDMAKTCVQVADSNYHEAVTHLGRTHLFISPFVIATHR

QLLPSHPVSVLLRPHFEGTLSINNGAQSMLMAPEGGVDTVLAATIDCARVLAVKGLQSYSFNQAMLPQQLQQLGL

DNAAALPIHPYRDDALLIWQAIETWVTDYVSLYYPTDDSVQKDAALQAWAQELQAEEGGRVPDFGEDGQLRTQA

YLIQALTLIIFTASAQHAAVNFPQGDIMVYTPGMPLAGYQPAPNTTAMSSQDRLNQLPPLHQALNQLELTYLLGQI

YHTQLGQYEKSWFSDQRVLAPLHRFQANLLDIETAIAERNRHRPYPYRYLQPSNIPQSINI

-continued

Amino acid Sequence for 5MEE_A

SEQ ID NO: 239

MVQPSLPQDDTPDQQEQRNRAIAQQREAYQYSETAGILLIKTLPQSEMFSLKYLIERDKGLVSLIANTLASNIENIFD
PFDKLEDFEEMFPLLPKPLVMNTFRNDRVFARQRIAGPNPMVIERVVDKLPDNFPVTDAMFQKIMFTKKTLAEAIA
QGKLFITNYKGLAELSPGRYEYQKNGTLVQKTKTIAAPLVLYAWKPEGFGDYRGSLAPIAIQINQQPDPITNPIYTPR
DGKHWFIAKIFAQMADGNCHEAISHLARTHLILEPFVLATANELAPNHPLSVLLKPHFQFTLAINELAREQVISAGGY
ADDLLAGTLEASIAVIKAAIKEYMDNFTEFALPRELARRGVGIGDVDQRGENFLPDYPYRDDAMLLWNAIEVYVRD
YLSLYYQSPVQIRQDTELQNWVRRLVSPEGGRVTGLVSNGELNTIEALVAIATQVIFVSGPQHAAVNYPQYDYMAF
IPNMPLATYATPPNKESNISEATILNILPPQKLAARQLELMRTLCVFYPNRLGYPDTEFVDVRAQQVLHQFQERLQEI
EQRIVLCNEKRLEPYTYLLPSNVPNSTSI

8. Consensus Sequence Motifs (SEQ ID NO: 240)
AKxxxxxADxxxxxxxxHxxxxHxxxxPxA, (SEQ ID NO: 241)
VxGxxxxxxxxxxLxxxxxxxxxxxxxxHxxxNxxQxxYxxxxxN, (SEQ ID NO: 242)
LxxxxxxIxxxNxxxxxxYxxxxPxxxxxSI;

(SEQ ID NO: 243)
LxxxxxYxxxxx$X_1$xxxxxx$X_2$GxxxxxxxKxLPxPxxxFxWxxx$X_3$xxxPxxI (SEQ ID NO: 244)
WxxAKxCxQxADxxHxExxxHxxxxHxxMxPxA;

(SEQ ID NO: 245)
GxVxGxxxxxxxxxxLxxxxxxxxxxCxPxHxxxNxxQxxYxxxxxNMPxAxY, (SEQ ID NO: 246)
QxxxxxxLxxxxxDxxGxYxxx$X_4$F, (SEQ ID NO: 247)
QxxLxxxxxxIxxxNxxRxxxYxxxxxxxxxNSI, (SEQ ID NO: 248)
LxxxxxYxxxxx$X_1$xxxxxx$X_2$GGxxxxxxKxLPxPxAxFxWxxx$X_3$xxxPxxI, (SEQ ID NO: 249)
WxxAKxCxQxADxNHxExxxHxxxTHxVMxPxAxxT, (SEQ ID NO: 250)
GxVxGxxxxxxxxxxLxxxxxxxxxxCxPxHxxxNxxQxxYxxxxxNMPxAxY, (SEQ ID NO: 251)
QxxxxxxLxxxxYDxLGxYxxx $X_4$ F, (SEQ ID NO: 252)
FQxxLxxxxxxIxxxNxxRxxxYxxxxPxxxxNSI 9. LOX mutants
Codon-optimized coding sequence of WP_002738122.1mut

SEQ ID NO: 253

ATGGTGAACACCCCGCCGCCGACCCCGTGCCTGCCGCAGAACGAGCCGGATGCGAACCGTCGTGCGGATAGC
CTGAACCTGCAGCGTCAAGCGTACCGTTATGACTACCAGTATCTGCCGCCGCTGGTGCTGATGGAGAGCGTTC
CGGCGGCGGAAAACTTCAGCTTTCAATATATTACCGAACGTCTGGCGGCGACCGCGGAACTGCCGGCGAACA
TGCTGGCGGTGAAGGTTAAAAGCTTCCTGGACCCGCTGGATGAGCTGCAGGACTACGAAGATTTCTTTGCGAT
CATTCCGCTGCCGAAGATCGCGAAAGTGTATCAGACCAACGATGCGTTTGCGGAACAACGTCTGAGCGGTGC
GAACCCGCTGGTTCTGCACCTGCTGAAGCCGGGTGATGCGCGTGCGCAGGTTCTGAACCAAATTCCGAGCAG
CAAAACCGATTTCGAGCCGCTGTTTCAGGTTAACCAAGAACTGGCGGCGGGCAACATCTACATTTGCGACTAT
ACCGGCACCGATATCAACTACCTGGGTCCGAGCCTGATTCAGGGTGGCACCCACGCGAAGGGTCGTAAATAT
CTGCCGAAGCCGCGTGCGTTCTTTTGGTGGCGTAAGAGCGGCATCCGTGACCGTGGTAAACTGGTGCCGATC
GCGATTCAGTTCGGCGAGAACGCGGAAAAGCTGTACACCCCGTTCGAGAAAAACCCGCTGGCGTGGCTGTTT

-continued

GCGAAGATTTGCGTGCAAGTTGCGGATAGCAACCACCACGAAATGAACAGCCACCTGTGCCGTACCCACTTCG
TTATGGAGCCGATCGCGATTTGCACCGCGCGTCAGCTGGCGGAAAACCACCCGCTGAGCCTGCTGCTGAAAC
CGCACCTGCGTTTTATGCTGACCAACAACAGCCTGGGTCAAGAGCGTCTGATCAACCCGGGTGGCCCGGTGG
ATGAGCTGCTGGCGGGCACCCTGGGTGAAAGCATGGCGCTGGTTAAGGACGCGTACGCGAACTGGAACCTG
CGTGATTTCGCGTTTCCGAAAGAGATTAGCAACCGTGGCATGGACGATACCGAACGTCTGCCGCACTACCCGT
ATCGTGACGATGGTATGCTGGTGTGGCAGAGCATCAACCAATTCGTTAGCGACTACCTGCACTACTTTTATCCG
AACCCGCAGGACATTACCAACGATCAGGAGCTGCAAGCGTGGGCGGGTGAATGCAGCAACAGCGCGGCGGA
TCAAGGTGGCAACGTGAAGGGTATGCCGGCGAACTTCACCGACGTTGAGGATCTGATCGAAGTGGTTACCAC
CATCATTTTTATTTGCGGCCCGCTGCACAGCGCGGTTAACTACGGCCAGTACGACTATATGACCTTTGCGGCGA
ACATGCCGCTGGCGGCGTATTGCGACCTGCCGGAGGCGATCAAGGATACCACCGGTAGCATCATTGGCGACG
CGCGTGGTAGCATCACCGAAAAAGATATTCTGCAGCTGCTGCCGCCGTACAAGAAAGCGGCGGATCAGCTGC
AAAGCCTGTTCACCCTGAGCGACTACCGTTATGATCAACTGGGCTACTATGACAAGGCGTTTCGTGAGCTGTA
TGGTCGTAAATTCGAGGAAGTGTTTGCGGAAGGCGATCAGGCGACCATCACCGGTTTCCTGCGTCAATTTCAG
CAAAACCTGAACATGAACGAGCAGGAAATCGACGCGAACAACCAAAAGCGTATTGTTCCGTACACCTATCTGA
AACCGAGCCTGATTCTGAACAGCATCAGCATTTAA

Amino acid sequence for WP_002738122.1mut

SEQ ID NO: 254

MVNTPPPTPCLPQNEPDANRRADSLNLQRQAYRYDYQYLPPLVLMESVPAAENFSFQYITERLAATAELPANMLA
VKVKSFLDPLDELQDYEDFFAIIPLPKIAKVYQTNDAFAEQRLSGANPLVLHLLKPGDARAQVLNQIPSSKTDFEPLFQ
VNQELAAGNIYICDYTGTDINYLGPSLIQGGTHAKGRKYLPKPRAFFWWRKSGIRDRGKLVPIAIQFGENAEKLYTPF
EKNPLAWLFAKICVQVADSNHHEMNSHLCRTHFVMEPIAICTARQLAENHPLSLLLKPHLRFMLTNNSLGQERLIN
PGGPVDELLAGTLGESMALVKDAYANWNLRDFAFPKEISNRGMDDTERLPHYPYRDDGMLVWQSINQFVSDYL
HYFYPNPQDITNDQELQAWAGECSNSAADQGGNVKGMPANFTDVEDLIEVVTTIIFICGPLHSAVNYGQYDYMT
FAANMPLAAYCDLPEAIKDTTGSIIGDARGSITEKDILQLLPPYKKAADQLQSLFTLSDYRYDQLGYYDKAFRELYGRK
FEEVFAEGDQATITGFLRQFQQNLNMNEQEIDANNQKRIVPYTYLKPSLILNSISI

Codon-optimized coding sequence of WP_002738122.1mut2

SEQ ID NO: 255

ATGGTGAACACCCCGCCGCCGACCCCGTGCCTGCCGCAGAACGAGCCGGATGCGAACCGTCGTGCGGATAGC
CTGAACCTGCAGCGTCAAGCGTACCGTTATGACTACCAGTATCTGCCGCCGCTGGTGCTGATGGAGAGCGTTC
CGGCGGCGGAAAACTTCAGCTTTCAATATATTACCGAACGTCTGGCGGCGACCGCGGAACTGCCGGCGAACA
TGCTGGCGGTGAAGGTTAAAAGCTTCCTGGACCCGCTGGATGAGCTGCAGGACTACGAAGATTTCTTTGCGAT
CATTCCGCTGCCGAAGATCGCGAAAGTGTATCAGACCAACGATGCGTTTGCGGAGCAACGTCTGAGCGGTGC
GAACCCGCTGGTTCTGCACCTGCTGAAGCCGGGTGATGCGCGTGCGCAGGTTCTGAACCAAATTCCGAGCAG
CAAAACCGATTTCGAACCGCTGTTTCAGGTTGAGCAAGAACTGGCGGCGGGCAACATCTACATTTGCGACTAT
ACCGGCACCGATATCAACTACCTGGGTCCGTGCATGATTCAGGGTGGCACCCACGCGAAGGGTCGTAAATAT
CTGCCGAAGCCGCGTGCGTTCTTTTGGTGGCGTAAGAGCGGCATCCGTGACCGTGGTAAACTGGTGCCGATC
GCGATTCAGTTCGGCGAGAACGCGGAAAAGCTGTACACCCCGTTCGAGAAAAACCCGCTGGCGTGGCTGTTT
GCGAAGATTTGCGTGCAAGTTGCGGATAGCAACCACCACGAAATGAACAGCCACCTGTGCCGTACCCACTTCG
TTATGGAGCCGATCGCGATTTGCACCGCGCGTCAGCTGGCGGAAAACCACCCGCTGAGCCTGCTGCTGAAAC
CGCACCTGCGTTTTATGCTGACCAACAACCACCTGGGTCAAGAACGTCTGATCAACCCGGGTGGCCCGGTGGA
TGAGCTGCTGGCGGGCACCCTGGGTGAAAGCATGGCGCTGGTTAAGGACGCGTACGCGAACTGGAACCTGC
GTGATTTCGCGTTTCCGAAAGAGATTAGCAACCGTGGCATGGACGATACCGAACGTCTGCCGCACTACCCGTA

-continued

TCGTGACGATGGTATGCTGGTGTGGCAGAGCATCAACCAATTCGTTAGCGACTACCTGCACTACTTTTATCCGA

ACCCGCAGGACATTACCAACGATCAGGAGCTGCAAGCGTGGGCGGGTGAATGCAGCAACAGCGCGGCGGAT

CAAGGTGGCAACGTGAAGGGTATGCCGGCGAACTTCACCGACGTTGAGGATCTGATCGAAGTGGTTACCACC

ATCATTTTTATTTGCGGCCCGCTGCACAGCGCGGTTAACTACGGCCAGTACGACTATATGACCTTTGCGGCGAA

CATGCCGCTGGCGGCGTATTGCGACCTGCCGGAGGCGATCAAGGATACCACCGGTAGCATCATTGGCGACGC

GCGTGGTAGCATCACCGAAAAAGATATTCTGCAGCTGCTGCCGCCGTACAAGAAAGCGGCGGATCAGCTGCA

AAGCCTGTTCACCCTGAGCGACTACCGTTATGATCAACTGGGCTACTATGACAAGGCGTTTCGTGAGCTGTAT

GGTCGTAAATTCGAGGAAGTGTTTGCGGAAGGCGATCAGGCGACCATCACCGGTTTCCTGCGTCAATTTCAGC

AAAACCTGAACATGAACGAGCAGGAAATCGACGCGAACAACCAAAAGCGTATTGTTCCGTACACCTATCTGA

AACCGAGCCTGATTCTGAACAGCATCAGCATTTAA

Amino acid sequence for WP_002738122.1mut2

SEQ ID NO: 256

MVNTPPPTPCLPQNEPDANRRADSLNLQRQAYRYDYQYLPPLVLMESVPAAENFSFQYITERLAATAELPANMLA

VKVKSFLDPLDELQDYEDFFAIIPLPKIAKVYQTNDAFAEQRLSGANPLVLHLLKPGDARAQVLNQIPSSKTDFEPLFQ

VEQELAAGNIYICDYTGTDINYLGPCMIQGGTHAKGRKYLPKPRAFFWWRKSGIRDRGKLVPIAIQFGENAEKLYTP

FEKNPLAWLFAKICVQVADSNHHEMNSHLCRTHFVMEPIAICTARQLAENHPLSLLLKPHLRFMLTNNHLGQERLI

NPGGPVDELLAGTLGESMALVKDAYANWNLRDFAFPKEISNRGMDDTERLPHYPYRDDGMLVWQSINQFVSDY

LHYFYPNPQDITNDQELQAWAGECSNSAADQGGNVKGMPANFTDVEDLIEVVTTIIFICGPLHSAVNYGQYDYM

TFAANMPLAAYCDLPEAIKDTTGSIIGDARGSITEKDILQLLPPYKKAADQLQSLFTLSDYRYDQLGYYDKAFRELYGR

KFEEVFAEGDQATITGFLRQFQQNLNMNEQEIDANNQKRIVPYTYLKPSLILNSISI

Codon-optimized coding sequence of WP_015204462.1mut

SEQ ID NO: 257

ATGCCGCAACCGTGCCTGCCGCAGAACGAGCCGAACCCGGAAAAACGTAACAACGACCTGAGCGATCAGCAA

CAGGCGTACGAGTATGATTACAAGTATCTGCCGCCGCTGGTGCTGCTGAAGAAAATTCCGGCGTTCGAAAACT

TTAGCGCGCAGTACATCGCGGAACGTGTGGTTGCGACCAGCGAGCTGGTTCCGAACATGCTGGCGGCGAAAG

CGCGTAGCTTTCTGGACCCGCTGGACGATATCAAGGACTACGAGGACCTGTTCACCCTGCTGCCGCTGCCGGA

AGTGGCGAAAGTTTATCAAACCAACAACAGCTTTGCGGAGCAGCGTCTGAGCGGTGCGAACCCGTTCGTGAT

TCGTCTGCTGGACGAGGACGATGCGCGTAGCCAAGTTCTGGAACAGATCCCGAGCTTCAAAGACGATTTTGA

GCCGCTGTTCGATGTGCGTAAGGAACTGGCGGCGGGTAACATCTACATTTGCGACTATACCGGCACCGATGA

GTACTATCGTGGCCCGAGCATGGTTCAGGGTGGCACCTACGAAAAGGGCCGTAAATATCTGCCGAAACCGCT

GGCGTTCTTTTGGTGGCAACGTACCGGTATTAGCGACCGTGGCAAGCTGGTGCCGATCGCGATTCAGCTGGA

TGCGAGCAAGAACAGCAAAGTGTACACCCCGACCAACAGCAAAGTTTATACCCCGTTTGAGCAAAACCCGCTG

GACTGGCTGTTCGCGAAGCTGTGCGTGCAGATCGCGGATGGTAACCACCACGAAATGAGCAGCCACCTGTGC

CGTACCCACTTCGTTATGGAGCCGATCGCGATTTGCACCGCGCACCAGCTGGCGGAAAACCACCCGCTGAGCC

TGCTGCTGCGTCCGCACTTCCTGTTTATGCTGACCAACAACAGCCTGGGCCAACAGCGTCTGATCAACCCGGG

TGGCCCGGTGGATGAGCTGCTGGCGGGCACCCTGCCGGAGAGCATGGAACTGGTTAAGGATGCGTACGAGG

GCTGGAACATTAAAGAATTCGCGTTTCCGACCGAGATCAAGAACCGTGGTATGGACAACACCGAACGTCTGC

CGCACTACCCGTATCGTGACGATGGCATGCTGGTTTGGAAAGCGATTCACACCTTTGTGAGCGATTACGTTAA

CCACTTCTATCCGACCCCGGAAGACATCACCGGTGATACCGAGCTGCAAGCGTGGGCGAAGGAATGCAGCGA

CCAAAGCGCGCAGACCAACGGTGGCAAGGTGAAAGGCATGCCGACCAGCTTTACCACCGTGCAGGAGCTGA

TCGAAATTGTTACCACCATCATTTTCATTTGCGGTCCGCAACACAGCGCGGTTAACTACGCGCAGGATGGCTAT

ATGACCTTTGCGGCGAACATGCCGCTGGCGGCGTACCGTGACATCCCGAAGCAGAGCCACAAACCGCAGGAT

CAACCGACCGCGACCCCGAGCGTGGCGGTTCAAACCACCGCGGAGCAGACCACCGCGGAACAAACCAAGGC

-continued

GGTGGAAATTACCGCGGACAAAGCGACCCTGGATCAGAACACCGTTCTGCAAAAACGTGCGGTGCAGACCAC
CACCGTTGAGATCCCGGAAGACCAAATTACCGAGGAACAGATCCTGAAGCTGCTGCCGCCGTACAAACGTAC
CGCGGACCAACTGCAGAGCCTGTTTGTGCTGAGCGCGTACCAATATGATCGTCTGGGTTACTATGAGAAGGC
GTTCCAACAGCTGTACAACGACAAGTTCGAAGATGTTTTCAAGGACGATAACAACCAAGCGATCATTGCGATT
GTGCGTCAGTTCCAACAGAACCTGAACATGGTTGAGCAGGAAATCGACGCGAACAACAAGAAACGTGTGGTT
CCGTACCTGTATCTGAAGCCGAGCCTGATCCTGAACAGCATCAGCATTTAA

Amino acid sequence for WP_015204462.1mut

SEQ ID NO: 258

MPQPCLPQNEPNPEKRNNDLSDQQQAYEYDYKYLPPLVLLKKIPAFENFSAQYIAERVVATSELVPNMLAAKARSF
LDPLDDIKDYEDLFTLLPLPEVAKVYQTNNSFAEQRLSGANPFVIRLLDEDDARSQVLEQIPSFKDDFEPLFDVRKELA
AGNIYICDYTGTDEYYRGPSMVQGGTYEKGRKYLPKPLAFFWWQRTGISDRGKLVPIAIQLDASKNSKVYTPTNSK
VYTPFEQNPLDWLFAKLCVQIADGNHHEMSSHLCRTHFVMEPIAICTAHQLAENHPLSLLLRPHFLFMLTNNSLGQ
QRLINPGGPVDELLAGTLPESMELVKDAYEGWNIKEFAFPTEIKNRGMDNTERLPHYPYRDDGMLVWKAIHTFVS
DYVNHFYPTPEDITGDTELQAWAKECSDQSAQTNGGKVKGMPTSFTTVQELIEIVTTIIFICGPQHSAVNYAQDGY
MTFAANMPLAAYRDIPKQSHKPQDQPTATPSVAVQTTAEQTTAEQTKAVEITADKATLDQNTVLQKRAVQTTTV
EIPEDQITEEQILKLLPPYKRTADQLQSLFVLSAYQYDRLGYYEKAFQQLYNDKFEDVFKDDNNQAIIAIVRQFQQNL
NMVEQEIDANNKKRVVPYLYLKPSLILNSISI

Codon-optimized coding sequence of WP_015204462.1mut2

SEQ ID NO: 259

ATGCCGCAACCGTGCCTGCCGCAGAACGAGCCGAACCCGGAAAAACGTAACAACGACCTGAGCGATCAGCAA
CAGGCGTACGAGTATGATTACAAGTATCTGCCGCCGCTGGTGCTGCTGAAGAAAATTCCGGCGTTCGAAAACT
TTAGCGCGCAGTACATCGCGGAACGTGTGGTTGCGACCAGCGAGCTGGTTCCGAACATGCTGGCGGCGAAAG
CGCGTAGCTTTCTGGACCCGCTGGACGATATCAAGGACTACGAGGACCTGTTCACCCTGCTGCCGCTGCCGGA
AGTGGCGAAAGTTTATCAAACCAACAACAGCTTTGCGGAGCAGCGTCTGAGCGGTGCGAACCCGTTCGTGAT
TCGTCTGCTGGACGAGGACGATCCGCGTAGCCAAGTTCTGGAACAGATCCCGAGCTTCAAAGACGATTTTGA
GCCGCTGTTCGATGTGCGTAAGGAACTGGCGGCGGGTAACATCTACATTTGCGACTATACCGGCACCGATGA
GTACTATCGTGGCCCGAGCATGGTTCAGGGTGGCACCTACGAAAAGGGCCGTAAATATCTGCCGAAACCGCT
GGCGTTCTTTTGGTGGCAACGTACCGGTATTAGCGACCGTGGCAAGCTGGTGCCGATCGCGATTCAGCTGGA
TGCGAGCAAGAACAGCAAAGTGTACACCCCGACCAACAGCAAAGTTTATACCCCGTTTGAGCAAAACCCGCTG
GACTGGCTGTTCGCGAAGCTGTGCGTGCAGATCGCGGATAGCAACCACCACGAAATGAGCAGCCACCTGTGC
CGTACCCACTTCGTTATGGAGCCGATCGCGATTTGCACCGCGCACCAGCTGGCGGAAAACCACCCGCTGAGCC
TGCTGCTGCGTCCGCACTTCCTGTTTATGCTGACCAACAACAGCCTGGGTCAACAGCGTCTGATCAACCCGGGT
GGCCCGGTGGATGAGCTGCTGGCGGGCACCCTGCCGGAGAGCATGGAACTGGTTAAGGATGCGTACGAGGG
CTGGAACATTAAAGAATTCGCGTTTCCGACCGAGATCAAGAACCGTGGTATGGACAACACCGAACGTCTGCC
GCACTACCCGTATCGTGACGATGGCATGCTGGTTTGGAAAGCGATTCACACCTTTGTGAGCGATTACGTTAAC
CACTTCTATCCGACCCCGGAAGACATCACCGGTGATACCGAGCTGCAAGCGTGGGCGAAGGAATGCAGCGAC
CAAAGCGCGCAGACCAACGGTGGCAAGGTGAAAGGCATGCCGACCAGCTTTACCACCGTGCAGGAGCTGAT
CGAAATTGTTACCACCATCATTTTCATTTGCGGTCCGCAACACAGCGCGGTTAACTACGCGCAGGATGGCTATA
TGACCTTTGCGGCGAACATGCCGCTGGCGGCGTACCGTGACATCCCGAAGCAGAGCCACAAACCGCAGGATC
AACCGACCGCGACCCCGAGCGTGGCGGTTCAAACCACCGCGGAGCAGACCACCGCGGAACAAACCAAGGCG
GTGGAAATTACCGCGGACAAAGCGACCCTGGATCAGAACACCGTTCTGCAAAAACGTGCGGTGCAGACCACC
ACCGTTGAGATCCCGGAAGACCAAATTACCGAGGAACAGATCCTGAAGCTGCTGCCGCCGTACAAACGTACC

-continued

GCGGACCAACTGCAGAGCCTGTTTGTGCTGAGCGCGTACCAATATGATCGTCTGGGTTACTATGAGAAGGCG

TTCCAACAGCTGTATGGCGACAAGTTTGAAGATGTTTTCAAAGACGATAACAACCAAGCGATCATTGCGATTG

TGCGTCAGTTCCAACAGAACCTGAACATGGTTGAGCAGGAAATCGACGCGAACAACAAGAAACGTGTGGTTC

CGTACCTGTATCTGAAGCCGAGCCTGATCCTGAACAGCATCAGCATTTAA

Amino acid sequence for WP_015204462.1mut2

SEQ ID NO: 260

MPQPCLPQNEPNPEKRNNDLSDQQQAYEYDYKYLPPLVLLKKIPAFENFSAQYIAERVVATSELVPNMLAAKARSF

LDPLDDIKDYEDLFTLLPLPEVAKVYQTNNSFAEQRLSGANPFVIRLLDEDDPRSQVLEQIPSFKDDFEPLFDVRKELA

AGNIYICDYTGTDEYYRGPSMVQGGTYEKGRKYLPKPLAFFWWQRTGISDRGKLVPIAIQLDASKNSKVYTPTNSK

VYTPFEQNPLDWLFAKLCVQIADSNHHEMSSHLCRTHFVMEPIAICTAHQLAENHPLSLLLRPHFLFMLTNNSLGQ

QRLINPGGPVDELLAGTLPESMELVKDAYEGWNIKEFAFPTEIKNRGMDNTERLPHYPYRDDGMLVWKAIHTFVS

DYVNHFYPTPEDITGDTELQAWAKECSDQSAQTNGGKVKGMPTSFTTVQELIEIVTTIIFICGPQHSAVNYAQDGY

MTFAANMPLAAYRDIPKQSHKPQDQPTATPSVAVQTTAEQTTAEQTKAVEITADKATLDQNTVLQKRAVQTTTV

EIPEDQITEEQILKLLPPYKRTADQLQSLFVLSAYQYDRLGYYEKAFQQLYGDKFEDVFKDDNNQAIIAIVRQFQQNL

NMVEQEIDANNKKRVVPYLYLKPSLILNSISI

Codon-optimized coding sequence of WP_015204462.1mut3

SEQ ID NO: 261

ATGCCGCAACCGTGCCTGCCGCAGAACGAGCCGAACCCGGAAAAACGTAACAACGACCTGAGCGATCAGCAA

CAGGCGTACGAGTATGATTACAAGTATCTGCCGCCGCTGGTGCTGCTGAAGAAAATTCCGGCGTTCGAAAACT

TTAGCGCGCAGTACATCGCGGAACGTGTGGTTGCGACCAGCGAGCTGGTTCCGAACATGCTGGCGGCGAAAG

CGCGTAGCTTTCTGGACCCGCTGGACGATATCAAGGACTACGAGGACCTGTTCACCCTGCTGCCGCTGCCGGA

AGTGGCGAAAGTTTATCAAACCAACAACAGCTTTGCGGAGCAGCGTCTGAGCGGTGCGAACCCGTTCGTGAT

TCGTCTGCTGGACGAGGACGATGCGCGTAGCCAAGTTCTGGAACAGATCCCGAGCTTCAAAGACGATTTTGA

ACCGCTGTTCGATGTGGAGAAGGAACTGGCGGCGGGTAACATCTACATTTGCGACTATACCGGCACCGATGA

GTACTATCGTGGCCCGAGCATGGTTCAAGGTGGCACCTACGAAAAGGGCCGTAAATATCTGCCGAAGCCGCT

GGCGTTCTTTTGGTGGCAGCGTACCGGTATTAGCGACCGTGGCCAACTGGTGCCGATCGCGATTCAGCTGGA

CCCGAGCAAGAACAGCAAAGTGTACACCCCGACCAACAGCAAAGTTTATACCCCGTTTGAGCAAAACCCGCTG

GACTGGCTGTTCGCGAAGCTGTGCGTGCAGATCGCGGATGCGAACCACCACGAAATGAGCAGCCACCTGTGC

CGTACCCACTTCGTTATGGAGCCGATCGCGATTTGCACCGCGCACCAGCTGGCGGAAAACCACCCGCTGAGCC

TGCTGCTGCGTCCGCACTTCCTGTTTATGCTGACCAACAACAGCCTGGGCCAACAGCGTCTGATCAACCCGGG

TGGCCCGGTGGATGAGCTGCTGGCGGGCACCCTGCCGGAGAGCATGGAACTGGTTAAGGATGCGTACGAGG

GCTGGAACATTAAAGAGTTCGCGTTTCCGACCGAGATCAAGAACCGTGGTATGGACAACACCGAACGTCTGC

CGCACTACCCGTATCGTGACGATGGCATGCTGGTTTGGAAAGCGATTCACACCTTTGTGAGCGATTACGTTAA

CCACTTCTATCCGACCCCGGAAGACATCACCGGTGATACCGAGCTGCAAGCGTGGGCGAAGGAATGCAGCGA

CCAAAGCGCGCAGACCAACGGTGGCAAGGTGAAAGGCATGCCGACCAGCTTTACCACCGTGCAGGAGCTGA

TCGAAATTGTTACCACCATCATTTTCATTTGCGGTCCGCAACACAGCGCGGTTAACTACGCGCAGGATGGCTAT

ATGACCTTTGCGGCGAACATGCCGCTGGCGGCGTACCGTGACATCCCGAAGCAGAGCCACAAACCGCAGGAT

CAACCGACCGCGACCCCGAGCGTGGCGGTTCAAACCACCGCGGAGCAGACCACCGCGGAACAAACCAAGGC

GGTGGAGATTACCGCGGACAAAGCGACCCTGGATCAGAACACCGTTCTGCAAAAACGTGCGGTGCAGACCAC

CACCGTTGAGATCCCGGAAGACCAAATTACCGAGGAACAGATCCTGAAGCTGCTGCCGCCGTACAAACGTAC

CGCGGACCAACTGCAGAGCCTGTTTGTGCTGAGCGCGTACCAGTATGATCGTCTGGGTTACTATGAGAAGGC

GTTCCAACAGCTGTACAACGACAAGTTCGAAGATGTTTTCAAGGACGATAACAACCAAGCGATCATTGCGATT

-continued

GTGCGTCAGTTCCAACAGAACCTGAACATGGTTGAGCAGGAAATCGACGCGAACAACAAGAAACGTGTGGTT

CCGTACCTGTATCTGAAACCGAGCCTGATCCTGAACAGCATCAGCATTTAA

Amino acid sequence for WP_015204462.1mut3

SEQ ID NO: 262

MPQPCLPQNEPNPEKRNNDLSDQQQAYEYDYKYLPPLVLLKKIPAFENFSAQYIAERVVATSELVPNMLAAKARSF

LDPLDDIKDYEDLFTLLPLPEVAKVYQTNNSFAEQRLSGANPFVIRLLDEDDARSQVLEQIPSFKDDFEPLFDVEKELA

AGNIYICDYTGTDEYYRGPSMVQGGTYEKGRKYLPKPLAFFWWQRTGISDRGQLVPIAIQLDPSKNSKVYTPTNSK

VYTPFEQNPLDWLFAKLCVQIADANHHEMSSHLCRTHFVMEPIAICTAHQLAENHPLSLLLRPHFLFMLTNNSLGQ

QRLINPGGPVDELLAGTLPESMELVKDAYEGWNIKEFAFPTEIKNRGMDNTERLPHYPYRDDGMLVWKAIHTFVS

DYVNHFYPTPEDITGDTELQAWAKECSDQSAQTNGGKVKGMPTSFTTVQELIEIVTTIIFICGPQHSAVNYAQDGY

MTFAANMPLAAYRDIPKQSHKPQDQPTATPSVAVQTTAEQTTAEQTKAVEITADKATLDQNTVLQKRAVQTTTV

EIPEDQITEEQILKLLPPYKRTADQLQSLFVLSAYQYDRLGYYEKAFQQLYNDKFEDVFKDDNNQAIIAIVRQFQQNL

NMVEQEIDANNKKRVVPYLYLKPSLILNSISI

Codon-optimized coding sequence of WP_006635899.1mut

SEQ ID NO: 263

ATGGTGGATAACATGAAGCCGTGCCTGCCGCAAGACGATCCGAACCCGGAACAGCGTCACGACAGCCTGAAC

CGTCAGCAACAGGCGTACCAATTCGATTATGAAAGCCTGAGCCCGCTGGCGCTGCTGAAGGATGTGCCGGCG

GTTGAGAACTTTAGCAGCAAATACCTGGCGGAGCGTATCCTGGCGACCAGCGAACTGCCGGCGAACATGCTG

GCGGCGGACAGCCGTACCTTCCTGGACCCGCTGGATGAGCTGCAGGACTACGAAGATTTCTTTACCTGGCTGC

CGCTGCCGGGTGTGGCGAAAATCTATCAAACCGATCGTAGCTTTGCGGAACAGCGTCTGAGCGGTGCGAACC

CGATGGTTCTGCGTCTGCTGCACCAAGAGGACGCGCGTGCGGAAACCCTGGCGCAACTGTGCTGCCTGCAGC

CGCTGTTCGACCTGCGTAAGGAGCTGCAGGATAAAAACATCTACATTTGCGACTATACCGGCACCGATGAACA

CTATCGTGGTCCGGCGAAGGTTGCGGGTGGCACCTACGAGAAGGGTCGTAAATATCTGCCGAAACCGCGTGC

GTTCTTTGCGTGGCGTTGGACCGGTATCCGTGATCGTGGCGAGATGACCCCGATCGCGATTCAACTGGACCCG

AAGCCGGGTAGCCACCTGTACACCCCGTTTGACCCGCCGATTGATTGGCTGTATGCGAAACTGTGCGTGCAGG

TTGCGGACGCGAACCACCACGAAATGAGCAGCCACCTGGGCCGTACCCACCTGGTGATGGAGCCGATCGCGA

TTTGCACCGCGCGTCAGCTGGCGAAGAACCACCCGCTGAGCCTGCTGCTGAAACCGCACTTCCGTTTTATGCT

GACCAACAACAGCCTGGCGCGTAGCCACCTGATTGCGCCGGGTGGCCCGGTTGATGAACTGCTGGGTGGCAC

CCTGGCGGAGACCATGGAACTGACCCGTGAGGCGTGCAGCACCTGGAGCCTGGATGAGTTTGCGCTGCCGGC

GGAACTGAAGAACCGTGGTATGGACGATCCGAACCAGCTGCCGCACTACCCGTATCGTGACGATGGCCTGCT

GCTGTGGGATGCGATCGAAACCTTTGTGAGCGGTTACCTGAAGTTCTTTTATCCGACCAACGAGGGCATTGTG

CAAGACGTTGAACTGCAGACCTGGGCGAAAGAGTGCGCGAGCGACGATGGTGGCAAGGTGAAGGGTATGCC

GCACCACATCGACACCGTTGAGCAGCTGATCGCGATTGTGACCACCGTTATTTTCACCTGCGGCCCGCAACAC

AGCGCGGTGAACTTCCCGCAGTACGATTATATGAGCTTTGCGGCGAACATGCCGCTGGCGGCGTACCGTGAC

ATCCCGGGTATTACCGCGAGCGGCCACCTGGAAGTGATCACCGAAAACGATATTCTGCGTCTGCTGCCGCCGT

ATAAGCGTGCGGCGGACCAACTGCAGATCCTGTTCATTCTGAGCGCGTACCGTTATGACCGTCTGGGTTACTA

TGATAAAAGCTTTCGTGAACTGTACCGTATGAGCTTCGATGAGGTTTTTGCGGGCACCCCGATCCAACTGCTG

GCGCGTCAGTTCCAACAGAACCTGAACATGGCGGAACAAAAGATCGACGCGAACAACCAGAAACGTGTGATT

CCGTATTTTGCGCTGAAACCGAGCCTGGTTCTGAACAGCATTAGCATGTAA

Amino acid sequence for WP_006635899.1mut

SEQ ID NO: 264

MVDNMKPCLPQDDPNPEQRHDSLNRQQQAYQFDYESLSPLALLKDVPAVENFSSKYLAERILATSELPANMLAAD

SRTFLDPLDELQDYEDFFTWLPLPGVAKIYQTDRSFAEQRLSGANPMVLRLLHQEDARAETLAQLCCLQPLFDLRKE

-continued

LQDKNIYICDYTGTDEHYRGPAKVAGGTYEKGRKYLPKPRAFFAWRWTGIRDRGEMTPIAIQLDPKPGSHLYTPFD

PPIDWLYAKLCVQVADANHHEMSSHLGRTHLVMEPIAICTARQLAKNHPLSLLLKPHFRFMLTNNSLARSHLIAPG

GPVDELLGGTLAETMELTREACSTWSLDEFALPAELKNRGMDDPNQLPHYPYRDDGLLLWDAIETFVSGYLKFFYP

TNEGIVQDVELQTWAKECASDDGGKVKGMPHHIDTVECILIAIVTTVIFTCGPQHSAVNFPQYDYMSFAANMPLA

AYRDIPGITASGHLEVITENDILRLLPPYKRAADQLQILFILSAYRYDRLGYYDKSFRELYRMSFDEVFAGTPIQLLARQF

QQNLNMAEQKIDANNQKRVIPYFALKPSLVLNSISM

Codon-optimized coding sequence of WP_015178512.1mut

SEQ ID NO: 265

ATGGTGGACAACATGAAGCCGTGCCTGCCGCAAGACGATCCGAACCAAGAGCAGCGTAAAGACAGCCTGAA

CCGTCAGCAACAGGCGTACCAGTTCGATTATGAGAGCCTGAGCCCGCTGGCGCTGCTGAAGAACGTGCCGGC

GGTTGAAAACTTTAGCAGCAAATACATCGGCGAGCGTATTCTGGCGACCAGCGAACTGCCGGCGAACATGCT

GGCGGCGGACAGCCGTACCTTCCTGGACCCGCTGGATGAGCTGCAAGACTACGAAGATTTCTTTACCCTGCTG

CCGCTGCCGGCGGTGGCGAAGATTTATCAAACCGATCGTAGCTTTGCGGAGCAGCGTCTGAGCGGTGCGAAC

CCGATGGTTCTGCGTCTGCTGGATGCGGGTGATGCGCGTGCGCAAACCCTGGCGCAGATCAGCAGCTTCCAC

CCGCTGTTTGACCTGGGCCAGGAACTGCAACAGAAAAACATTTACGTTTGCGACTATACCGGCACCGATGAGC

ACTACCGTGCGCCGAGCAAGATCGGTGGCGGTAGCTATGAAAAGGGCCGTAAATTCCTGCCGAAACCGCGTG

CGTTCTTTGCGTGGCGTTGGACCGGCATCCGTGACCGTGGTGAAATGACCCCGATCGCGATTCAACTGGACCC

GACCCCGGATAGCCATGTGTACACCCCGTTTGACCCGCCGGTTGATTGGCTGTTTGCGAAGCTGTGCGTGCAG

GTTGCGGATGCGAACCACCACGAGATGAGCAGCCACCTGGGTCGTACCCACCTGGTGATGGAACCGATCGCG

ATTTGCACCGCGCGTCAACTGGCGCAGAACCACCCGCTGAGCCTGCTGCTGAAACCGCACTTCCGTTTTATGCT

GACCAACAACAGCCTGGCGCGTAGCTACCTGATTGCGCCGGGCGGTCCGGTTGATGAGCTGCTGGGTGGCAC

CCTGCCGGAGACCATGGAAATCGCGCGTGAAGCGTGCAGCACCTGGAGCCTGGATGAGTTTGCGCTGCCGGC

GGAACTGAAGAACCGTGGCATGGACGATACCAACCAGCTGCCGCACTACCCGTATCGTGACGATGGCCTGCT

GCTGTGGGACGCGATTGAGACCTTTGTGAGCGGTTACCTGAAATTCTTTTATCCGACCGAAATCGCGATTGTG

CAAGACGTTGAGCTGCAAACCTGGGCGCAGGAATGCGCGAGCGATCGTGGCGGTAAAGTGAAAGGCATGCC

GCCGCGTATCAACACCGTGGAGCAGCTGATCAAGATTGTTACCACCATCATTTTCACCTGCGGTCCGCAACAC

AGCGCGGTTAACTTCCCGCAGTACGAATATATGAGCTTTGCGGCGAACATGCCGCTGGCGGCGTACCGTGAT

ATCCCGAAGATTACCGCGAGCGGTAACCTGGAAGTGATCACCGAAAAAGACATTCTGCGTCTGCTGCCGCCGT

ATAAGCGTGCGGCGGATCAGCTGAAAATCCTGTTCACCCTGAGCGCGTACCGTTATGACCGTCTGGGCTACTA

TGATAAGAGCTTTCGTGAGCTGTACCGTATGAGCTTCGACGAAGTTTTTGCGGGCACCCCGATTCAACTGCTG

GCGCGTCAGTTTCAACAGAACCTGAACATGGCGGAGCAAAAGATCGATGCGAACAACCAGAAACGTGTGATC

CCGTATATTGCGCTGAAACCGAGCCTGGTTATCAACAGCATTAGCATGTAA

Amino acid sequence for WP_015178512.1mut

SEQ ID NO: 266

MVDNMKPCLPQDDPNQEQRKDSLNRQQQAYQFDYESLSPLALLKNVPAVENFSSKYIGERILATSELPANMLAAD

SRTFLDPLDELQDYEDFFTLLPLPAVAKIYQTDRSFAEQRLSGANPMVLRLLDAGDARAQTLAQISSFHPLFDLGQEL

QQKNIYVCDYTGTDEHYRAPSKIGGGSYEKGRKFLPKPRAFFAWRWTGIRDRGEMTPIAIQLDPTPDSHVYTPFDP

PVDWLFAKLCVQVADANHHEMSSHLGRTHLVMEPIAICTARQLAQNHPLSLLLKPHFRFMLTNNSLARSYLIAPG

GPVDELLGGTLPETMEIAREACSTWSLDEFALPAELKNRGMDDTNQLPHYPYRDDGLLLWDAIETFVSGYLKFFYP

TEIAIVQDVELQTWAQECASDRGGKVKGMPPRINTVEQLIKIVTTIIFTCGPQHSAVNFPQYEYMSFAANMPLAAY

RDIPKITASGNLEVITEKDILRLLPPYKRAADQLKILFTLSAYRYDRLGYYDKSFRELYRMSFDEVFAGTPIQLLARQFQ

QNLNMAEQKIDANNQKRVIPYIALKPSLVINSISM

-continued

Codon-optimized coding sequence of WP_028091425.1mut

SEQ ID NO: 267

ATGCAGCCGTGCCTGCCGCAAAACGACCCGAACCCGAGCCAGCGTCAAAGCAGCCTGGAGAAGGGTCGTAA
GGAATACCAGTTCATGTACGATTTTCTGCCGCCGATGGCGATGATCAAGAGCGTGCCGCCGGCGGAGAACTT
CAGCACCAAATACATTGCGGAACGTACCCTGGAGGCGGCGGAACTGCCGCTGAACATGATGGCGGTTAAGAC
CCACGCGATGTGGGACCCGCTGGATGAGCTGCAGGACTACGAAGATTTCTTTCCGGTGCTGCAAAAGCCGAA
CGTTATGAAAACCTATGAGACCGACGATAGCTTTGCGGAACAGCGTCTGTGCGGCGTGAACCCGATGGTTCT
GCGTCAGATCAAGCAAATGGACGCGCGTTTCGCGTTTACCATTGAGGAACTGCAAGATAAATTCGGTAGCAG
CATCAACCTGATTGAGCGTCTGGCGACCGGCAACCTGTACGTGTGCGACTATCGTAGCCTGGCGTTTATCCAG
GGTGGCACCTACGCGAAGGGTAAGAAATATCTGCCGGCGCCGCTGGCGTTCTTTTGCTGGCGTACCAGCGGT
TTCCAGGATCGTGGCCAACTGGTGCCGGTTGCGATCCAGATTAACCCGAAAGCGGGTAAAGCGAGCCCGCTG
CTGACCCCGTTTGATGATCCGCTGACCTGGTTTTACGCGAAAAGCTGCGTTCAAATCGCGGACGCGAACCACC
ACGAGATGAGCAGCCACCTGTGCCGTACCCACCTGGTGATGGAGCCGTTTGCGGTTTGCACCCCGCGTCAGCT
GGCGGAAAACCACCCGCTGCGTATTCTGCTGAAGCCGCACTTCCGTTTTATGCTGGCGAACAACAGCCTGGCG
CGTAAACGTCTGGTTAGCCGTGGTGGCTTCGTTGACGAGCTGCTGGCGGGCACCCTGCAGGAAAGCCTGCAA
ATCGTGGTTGACGCGTACAAAAGCTGGAGCCTGGATCAGTTTGCGCTGCCGCGTGAACTGAAGAACCGTGGT
GTGAACGATGTTAAAAACCTGCCGCACTACCCGTATCGTGACGATGGCATCCTGCTGTGGAACGCGATTAACA
AGTTCGTGTTTAACTATCTGCAGCTGTACTATCAAAGCAGCGCGGACCTGAAGGCGGATGCGGAACTGCAGG
CGTGGGCGCGTGAATGCGTGGCGCAAGACGGTGGCCGTGTTAAGGGTATGAGCGACCGTATCGATACCCTG
GAGCAGCTGGTTGAGATCGTTACCACCATCATTTACATTTGCGGCCCGCAGCACAGCGCGGTGAACTTCAGCC
AATACGAATATATGGGCTTTATTCCGAACATGCCGCTGGCGGCGTATCAGCCGATCCAGCAAAAGGGTGACAT
TAAAGATCGTCAAGCGCTGATCGATTTCCTGCCGCCGGCGAAACCGACCAGCACCCAGCTGAGCACCGTTTAC
ATTCTGAGCGACTACCGTTATGATCGTCTGGGCTACTATGAGGAAGAGGAATTCACCGACCCGAACGCGGATC
AGGTGGTTAACAAGTTTCAGCAAGAGCTGAACATGGTGCAGCGTAAGATCGAACTGAACAACAAACGTCGTC
TGGTTAACTACAAATATCTGCAACCGCGTCTGATTCTGAACAGCATCAGCATTTAA

Amino acid sequence for WP_028091425.1mut

SEQ ID NO: 268

MQPCLPQNDPNPSQRQSSLEKGRKEYQFMYDFLPPMAMIKSVPPAENFSTKYIAERTLEAAELPLNMMAVKTHA
MWDPLDELQDYEDFFPVLQKPNVMKTYETDDSFAEQRLCGVNPMVLRQIKQMDARFAFTIEELQDKFGSSINLIE
RLATGNLYVCDYRSLAFIQGGTYAKGKKYLPAPLAFFCWRTSGFQDRGQLVPVAIQINPKAGKASPLLTPFDDPLTW
FYAKSCVQIADANHHEMSSHLCRTHLVMEPFAVCTPRQLAENHPLRILLKPHFRFMLANNSLARKRLVSRGGFVDE
LLAGTLQESLQIVVDAYKSWSLDQFALPRELKNRGVNDVKNLPHYPYRDDGILLWNAINKFVFNYLQLYYQSSADLK
ADAELQAWARECVAQDGGRVKGMSDRIDTLEQLVEIVTTIIYICGPQHSAVNFSQYEYMGFIPNMPLAAYQPIQQ
KGDIKDRQALIDFLPPAKPTSTQLSTVYILSDYRYDRLGYYEEEEFTDPNADQVVNKFQQELNMVQRKIELNNKRRL
VNYKYLQPRLILNSISI

Codon-optimized coding sequence of OBQ01436.1mut

SEQ ID NO: 269

ATGCAGCCGTGCCTGCCGCAAAACGACCCGAACCCGGCGCAGCGTCAAAGCTGCCTGGAGAAGGGTCGTAA
GGAATACCAGTTCATGTACGATTTTCTGCCGCCGATGGCGATGCTGAAGAGCGTTCCGCCGGCGGAGAACTTC
AGCACCAAATACATCGCGGAACGTACCCTGGAGGCGGCGGAACTGCCGCTGAACATGATGGCGGTGAAGAC
CCACGCGATGTGGGACCCGCTGGATGAGCTGCAGGACTACGAAGATTTCTTTCCGATTCTGCAAAAGCCGAAC
GTTATGAAAACCTATGAGACCGACGATAGCTTTGCGGAACAGCGTCTGTGCGGCGTGAACCCGATGGTTCTG
CGTCAGATCAAGCAAATGGACGCGCGTTTCGCGTTTACCATTGAGGAACTGCAAGCGAAATTCGGTAACAGC

-continued

ATCAACCTGATTGAGCGTCTGGCGACCGGCAACCTGTACGTTTGCGATTATCGTAGCCTGGCGTTTATCCAGG

GTGGCACCTACGCGAAGGGTAAGAAATATCTGCCGGCGCCGCTGGCGTTCTTTTGCTGGCGTAGCAGCGGTT

TCCAGGACCGTGGCCAACTGGTGCCGGTTGCGATCCAGATTAACCCGAAAGCGGGTAAAGCGAGCCCGCTGC

TGACCCCGTTTGATGATCCGCTGACCTGGTTTTACGCGAAAAGCTGCGTGCAAATCGCGGATGCGAACCACCA

CGAGATGAGCAGCCACCTGTGCCGTACCCACCTGGTGATGGAGCCGTTTGCGGTTTGCACCCCGCGTCAGCTG

GCGGAAAACCACCCGCTGCGTATTCTGCTGCGTCCGCACTTCCGTTTTATGCTGGCGAACAACAGCCTGGCGC

GTAAGCGTCTGGTTAGCCGTGGTGGCTTCGTTGACGAGCTGCTGGCGGGCACCCTGCAGGAAAGCCTGCAAA

TCGTGGTTGACGCGTACAAAAGCTGGAGCCTGGATCAGTTTGCGCTGCCGCGTGAACTGAAGAACCGTGGTG

TGGACGATGTTAAAAACCTGCCGCACTACCCGTATCGTGACGATGGCATCCTGCTGTGGAACGCGATTAACAA

GTTCGTGTTTAACTATCTGCAGCTGTACTATAAGAGCCCGGCGGACCTGAAGGCGGATGGTGAACTGCAGGC

GTGGGCGCGTGAATGCGTGGCGCAAGACGGTGGCCGTGTTAAAGGCATGAGCGACCGTATCGATACCCTGG

AGCAACTGGTGGAAATCGTTACCACCATCATTTACATTTGCGGCCCGCAGCACAGCGCGGTGAACTTCAGCCA

ATACGAGTATATGGGCTTTATTCCGAACATGCCGCTGGCGGCGTATCAGGAGATCCAGCAAAACGGTGACATT

GAAGATCGTCAAGCGCTGATCGATTTCCTGCCGCCGGCGAAGCCGACCAACACCCAGCTGAGCACCGTTTACA

TTCTGAGCGACTACCGTTATGATCGTCTGGGCTACTATGAGGAAGAGGAATTCACCGACCCGAACGCGGATCA

GGTGGTTAACAAATTTCAGCAAGAGCTGAGCGTGGTTCAGCGTAAGATCGAACTGAACAACAAAGGTCGTCT

GGTGAACTACGAATATCTGCAACCGGGCCTGATTCTGAACAGCATCAGCATTTAA

Amino acid sequence for OBQ01436.1mut

SEQ ID NO: 270

MQPCLPQNDPNPAQRQSCLEKGRKEYQFMYDFLPPMAMLKSVPPAENFSTKYIAERTLEAAELPLNMMAVKTH

AMWDPLDELQDYEDFFPILQKPNVMKTYETDDSFAEQRLCGVNPMVLRQIKQMDARFAFTIEELQAKFGNSINLI

ERLATGNLYVCDYRSLAFIQGGTYAKGKKYLPAPLAFFCWRSSGFQDRGQLVPVAIQINPKAGKASPLLTPFDDPLT

WFYAKSCVQIADANHHEMSSHLCRTHLVMEPFAVCTPRQLAENHPLRILLRPHFRFMLANNSLARKRLVSRGGFV

DELLAGTLQESLQIVVDAYKSWSLDQFALPRELKNRGVDDVKNLPHYPYRDDGILLWNAINKFVFNYLQLYYKSPA

DLKADGELQAWARECVAQDGGRVKGMSDRIDTLEQLVEIVTTIIYICGPQHSAVNFSQYEYMGFIPNMPLAAYQEI

QQNGDIEDRQALIDFLPPAKPTNTQLSTVYILSDYRYDRLGYYEEEEFTDPNADQVVNKFQQELSVVQRKIELNNKG

RLVNYEYLQPGLILNSISI

Codon-optimized coding sequence of OBQ25779.1mut

SEQ ID NO: 271

ATGATCAACATTATGCAGCCGTGCCTGCCGCAAAACGACCCGAACCCGGGTCAGCGTCAAAGCAGCCTGGAG

AAGGGCCGTAAGGAATACCAGTTCATGTACGATTTTCTGCCGCCGATGGCGATGCTGAAGAGCGTGCCGCCG

GCGGAGAACTTCAGCACCAAATACATCGCGGAACGTACCCTGGAGGCGGCGGAACTGCCGCTGAACATGATG

GCGGTTAAGACCCACGCGATGTGGGACCCGCTGGATGAGCTGCAGGACTACGAAGATTTCTTTCCGGTGCTG

CAAAAGCCGAACGTTATGAAAACCTATGAGACCGACGATAGCTTTGCGGAACAGCGTCTGTGCGGTGTGAAC

CCGATGGTTCTGCGTCAGATCAAGCAAATGGACGCGCGTTTCGCGTTTACCATTGAGGAACTGCAAGCGAAAT

TCGGTAACAGCATCAACCTGATTGAGCGTCTGGCGACCGGCAACCTGTACGTTTGCGATTATCGTAGCCTGGC

GTTTATCCAGGGTGGCACCTACGCGAAGGGTAAGAAATATCTGCCGGCGCCGCTGGCGTTCTTTTGCTGGCGT

AGCAGCGGTTTCCAGGACCGTGGCCAACTGGTGCCGGTTGCGATCCAGATTAACCCGAAAGCGGGTCAAGCG

AGCCCGCTGCTGACCCCGTTTGACAAGCCGCTGACCTGGTTTTACGCGAAAAGCTGCGTGCAGATCGCGGATG

CGAACCACCACGAGATGAGCAGCCACCTGTGCCGTACCCACCTGGTGATGGAGCCGTTTGCGGTTTGCACCCC

GCGTCAACTGGCGGAAAACCACCCGCTGCGTATTCTGCTGAAGCCGCACTTCCGTTTTATGCTGGCGAACAAC

AGCCTGGCGCGTAAACGTCTGGTTAGCCGTGGTGGCTTCGTTGACGAGCTGCTGGCGGGCACCCTGCAGGAA

AGCCTGCAAATCGTGGTTGACGCGTACAAAAGCTGGAGCCTGGATCAGTTTGCGCTGCCGCGTGAACTGAAG

-continued

AACCGTGGTGTGGACGATGTTAAAAACCTGCCGCACTACCCGTATCGTGACGATGGCATCCTGCTGTGGAACG

CGATTAACAAGTTCGTTTTTAACTATCTGCAGCTGTACTATAAGAGCCCGGCGGACCTGAAGGCGGATGGTGA

ACTGCAGGCGTGGGCGCGTGAATGCGTGGCGCAAGACGGTGGCCGTGTTAAAGGCATGAGCGACCGTATCG

ATACCCTGGAGCAACTGGTGGAAATCGTTACCACCATCATTTACATTTGCGGCCCGCAGCACAGCGCGGTGAA

CTTCAGCCAATACGAGTATATGGGCTTTATTCCGAACATGCCGCTGGCGGCGTATCAGGCGATCCAGCAAAAG

GGCGACATTAAAGATCGTCAAGCGCTGATCGATTTCCTGCCGCCGGCGAAGCCGACCAACACCCAGCTGAGC

ACCGTTTACATTCTGAGCGACTACCGTTATGATCGTCTGGGTTACTATGAGGAAGAGGAATTCACCGACCCGA

ACGCGGATCAGGTGGTTAACAAATTTCAGCAAGAGCTGAACGTGGTTCAGCGTAAGATCGAACTGAACAACA

AAGGCCGTCTGGTGAACTACGAATATCTGCAGCCGCGTCTGATTCTGAACAGCATCAGCATTTAA

Amino acid sequence for OBQ25779.1mut

SEQ ID NO: 272

MINIMQPCLPQNDPNPGQRQSSLEKGRKEYQFMYDFLPPMAMLKSVPPAENFSTKYIAERTLEAAELPLNMMAV

KTHAMWDPLDELQDYEDFFPVLQKPNVMKTYETDDSFAEQRLCGVNPMVLRQIKQMDARFAFTIEELQAKFGNS

INLIERLATGNLYVCDYRSLAFIQGGTYAKGKKYLPAPLAFFCWRSSGFQDRGQLVPVAIQINPKAGQASPLLTPFDK

PLTWFYAKSCVQIADANHHEMSSHLCRTHLVMEPFAVCTPRQLAENHPLRILLKPHFRFMLANNSLARKRLVSRG

GFVDELLAGTLQESLQIVVDAYKSWSLDQFALPRELKNRGVDDVKNLPHYPYRDDGILLWNAINKFVFNYLQLYYKS

PADLKADGELQAWARECVAQDGGRVKGMSDRIDTLEQLVEIVTTIIYICGPQHSAVNFSQYEYMGFIPNMPLAAY

QAIQQKGDIKDRQALIDFLPPAKPTNTQLSTVYILSDYRYDRLGYYEEEEFTDPNADQVVNKFQQELNVVQRKIELN

NKGRLVNYEYLQPRLILNSISI

Codon-optimized coding sequence of WP_039200563.1mut

SEQ ID NO: 273

ATGAAGCCGTGCCTGCCGCAGAACGATCCGAACCCGACCCAGCGTCAAAGCAGCCTGGAGAAGGGCCGTAA

AGAGTACGAATTCCGTTATGACTTTCTGCCGCCGATGGCGATGCTGAAGAACGTGCCGCCGAGCGAGAACTTC

AGCACCAAATACATTGCGGAACGTACCATCGAGACCGCGGAACTGCCGAGCAACATGATGGCGGTTAAAGCG

CACGCGATGTGGGACCCGCTGGATGAGCTGCAGGACTACGAAGATTTCTTTCCGGTGCTGCAAAAGCCGAAC

GTTATGAAAAACTATGAGACCGACGATAGCTTCGCGGAACAGCGTCTGTGCGGTGTGAACCCGGTGGTTCTG

TGCCAGATTAAGCAAATGGATGCGCGTTTCGCGTTTACCATCGAGGAACTGCAAGCGAAATTTGGTAACAGCA

TTGATCTGCGTGAGCGTCTGGCGACCGGCAACCTGTACGTTTGCGACTATCGTCCGCTGGCGTTCATCCGTGG

TGGCACCTTTGCGAAGGGTAAGAAATACCTGCCGGCGCCGCTGGCGTTCTTTTGCTGGCGTAGCAGCGGTTTC

CAGGATCGTGGCCAACTGGTGCCGATCGCGATTCAGATCAACCCGAAGGAAGGCAAAGCGAGCCCGCTGCTG

ACCCCGTTCGACGATAGCAGCACCTGGTTTTACGCGAAGAGCTGCGTTCAAATCGCGGACGCGAACCACCAC

GAGATGAGCAGCCACCTGTGCCGTACCCACTTCGTGATGGAACCGTTTGCGGTTTGCACCCCGCGTCAGCTGG

CGCAAAACCACCCGCTGCGTATTCTGCTGAAACCGCACTTCCGTTTTATGCTGGCGAACAACAGCCTGGGTCG

TCAGCGTCTGGTGAACCGTGGTGGCCCGGTTGATGAGCTGCTGGCGGGCACCCTGCAGGAAAGCCTGCAAAT

TGTGGTTGACGCGTACACCGATTGGCGTCTGGACCAATTCGCGCTGCCGACCGAGCTGAAGAACCGTGGTGT

GGACGATGTTAAAAACCTGCCGCACTACCCGTATCGTGACGATGGCATTCTGCTGTGGAACGCGATCAACAAG

TTCGTGTTCAACTACCTGGAACTGTACTACAAGAGCCCGGCGGATCTGACCGCGGATGTTGAACTGCAGGCGT

GGGCGCGTGAATGCGTGGCGCAAGATGGTGGCCGTGTTAAGGGTATGAGCGACCGTATTGATACCCTGAAA

CAGCTGGTTGAGATCGTTACCACCATCATTTACACCTGCGGTCCGCTGCACAGCGCGGTGAACTTCCCGCAGT

ACGAATATATGGGCTTTATCCCGAACATGCCGCTGGCGGCGTATCAACCGATTAAGAAAGAGGGTGTTTGCAC

CCGTAAGGAACTGATCGACTTCCTGCCGGCGGCGAAACCGACCAGCAGCCAGCTGACCACCCTGTTTACCCTG

AGCGCGTACCGTTATGATCGTCTGGGCTACTATGAGGAAGAGGAATTCGAGGACCCGAACGCGGACGATGTG

-continued

GTTAACAAATTTCAGCAAGAGCTGAACGTGGTTCAGCGTAAGATCGAACTGAGCAACAAAGGTCGTCTGGTG

AACTACGAATATCTGCAACCGCGTCTGATTCTGAACAGCATTAGCATCTAA

Amino acid sequence for WP_039200563.1mut

SEQ ID NO: 274

MKPCLPQNDPNPTQRQSSLEKGRKEYEFRYDFLPPMAMLKNVPPSENFSTKYIAERTIETAELPSNMMAVKAHA

MWDPLDELQDYEDFFPVLQKPNVMKNYETDDSFAEQRLCGVNPVVLCQIKQMDARFAFTIEELQAKFGNSIDLRE

RLATGNLYVCDYRPLAFIRGGTFAKGKKYLPAPLAFFCWRSSGFQDRGQLVPIAIQINPKEGKASPLLTPFDDSSTWF

YAKSCVQIADANHHEMSSHLCRTHFVMEPFAVCTPRQLAQNHPLRILLKPHFRFMLANNSLGRQRLVNRGGPVD

ELLAGTLQESLQIVVDAYTDWRLDQFALPTELKNRGVDDVKNLPHYPYRDDGILLWNAINKFVFNYLELYYKSPADL

TADVELQAWARECVAQDGGRVKGMSDRIDTLKQLVEIVTTIIYTCGPLHSAVNFPQYEYMGFIPNMPLAAYQPIKK

EGVCTRKELIDFLPAAKPTSSQLTTLFTLSAYRYDRLGYYEEEEFEDPNADDVVNKFQQELNVVQRKIELSNKGRLVN

YEYLQPRLILNSISI

Codon-optimized coding sequence of WP_012407347.1mut

SEQ ID NO: 275

ATGAAACCGTGCCTGCCGCAGAACGACCCGGATCCGACCAAACGTCAGATCCTGCTGGAGCGTAACCAAGGC

GAGTACGAATTCGACTATGATTTTCTGGTGCCGATGGCGATGCTGAAGAACGTTCCGAGCATTGAGAACTTCA

GCACCAAATACATCGCGGAACGTACCCTGGAGACCGCGGAACTGCCGATTAACATGCTGGCGGTGAAGACCC

GTAGCCTGTGGGACCCGCTGGATGAGCTGCAGGACTACGAAGATTATTTTCCGGTTCTGCCGAAGCCGAACAT

CATTAAAACCTACCAGAGCGACGATAGCTTCTGCGAGCAACGTCTGTGCGGCGCGAACCCGTTTGTGCTGCGT

CGTATTGAACAGATGGACGCGCGTTTCGCGTTTACCATCCTGGAGCTGCAAGAAAAGTTCGGTGATAGCATTA

ACCTGGTTGAGAAACTGGCGAACGGCAACCTGTACGTGTGCGACTATCGTGCGCTGGCGTTCGTTAAAGGTG

GCAGCTACGAACGTGGTAAGAAATTTCTGCCGACCCCGATCGCGTTCTTTTGCTGGCGTAGCAGCGGTTTCAG

CGACCGTGGCCAGCTGGTGCCGATCGTTATTCAAATCAACCCGGCGGATGGCAAGCAGAGCCAACTGATCAC

CCCGTTCGACGATCCGCTGACCTGGTTTCACGCGAAACTGTGCGTGCAGATTGCGGACGCGAACCACCACGAA

ATGAGCAGCCACCTGTGCCGTACCCACTTCGTTATGGAGCCGTTTGCGATTTGCACCGCGCGTCAACTGGCGG

AAAACCACCCGCTGAGCCTGCTGCTGAAGCCGCACTTCCGTTTTATGCTGGCGAACAACAGCCTGGCGCGTAA

ACGTCTGATCAGCCGTGGTGGCCCGGTGGATGAGCTGCTGGCGGGCACCCTGCAGGAAAGCCTGCAAATTGT

GGTTAACGCGTACACCGAGTGGAGCCTGGACCAGTTCAGCCTGCCGACCGAACTGAAGAACCGTGGTATGGA

CGATCCGGATAACCTGCCGCACTACCCGTATCGTGACGATGGCCTGCTGCTGTGGAACGCGATTAAGAAATTT

GTTAGCGAGTATCTGCAGATCTACTATAAGACCCCGCAAGACCTGGCGGAGGATCTGGAACTGCAGAGCTGG

GTGCAAGAATGCGTTAGCCAGAGCGGTGGCCGTGTGAAAGGTATTAGCGACCGTATCAACACCCTGGACCAA

CTGGTGGATATTGCGACCGCGGTTATTTTTACCTGCGGTCCGCAGCATGCGGCGGTTAACTACAGCCAATACG

AGTATATGACCTTTATGCCGAACATGCCGCTGGCGGCGTATAAACAGATGACCAGCGAAGGCACCATCCCGG

ATCGTAAGAGCCTGCTGAGCTTCCTGCCGCCGAGCAAACAGACCGCGGACCAACTGAGCATTCTGTTTATCCT

GAGCGCGTACCGTTATGATCGTCTGGGCTACTATGACGATAAGTTCCTGGACCCGGAGGCGCAAGATGTGCT

GGCGAAATTTCAGCAAGAACTGAACGAGGCGGAACGTGAGATTGAACTGAACAACAAGAGCCGTCTGATCA

ACTACAACTATCTGAAACCGCGTCTGGTGACCAACAGCATCAGCGTTTAA

Amino acid sequence for WP_012407347.1mut

SEQ ID NO: 276

MKPCLPQNDPDPTKRQILLERNQGEYEFDYDFLVPMAMLKNVPSIENFSTKYIAERTLETAELPINMLAVKTRSLW

DPLDELQDYEDYFPVLPKPNIIKTYQSDDSFCEQRLCGANPFVLRRIEQMDARFAFTILELQEKFGDSINLVEKLANG

NLYVCDYRALAFVKGGSYERGKKFLPTPIAFFCWRSSGFSDRGQLVPIVIQINPADGKQSQLITPFDDPLTWFHAKLC

VQIADANHHEMSSHLCRTHFVMEPFAICTARQLAENHPLSLLLKPHFRFMLANNSLARKRLISRGGPVDELLAGTL

QESLQIVVNAYTEWSLDQFSLPTELKNRGMDDPDNLPHYPYRDDGLLLWNAIKKFVSEYLQIYYKTPQDLAEDLEL

-continued

QSWVQECVSQSGGRVKGISDRINTLDQLVDIATAVIFTCGPQHAAVNYSQYEYMTFMPNMPLAAYKQMTSEGTI

PDRKSLLSFLPPSKQTADQLSILFILSAYRYDRLGYYDDKFLDPEAQDVLAKFQQELNEAEREIELNNKSRLINYNYLKP

RLVTNSISV

Codon-optimized coding sequence of WP_027843955.1mut

SEQ ID NO: 277

ATGAAACCGTGCCTGCCGCAGAACGACCCGAACCCGGAGAAGCGTAAAGATTGGCTGAACAAAAACCGTGA

GGAATACCAATTCAACTTTAACTATCTGAGCCCGCTGCCGCTGATCGACGATGTTCCGAACAACGAGGCGTTT

AGCCCGAAGTACCTGGCGGAACGTCTGCCGCTGACCTTCGGTAAACTGAGCGCGAACACCCTGGGCATTCGT

CTGCGTAGCTTTTGGGACCCGTTCGATGAGTTTCAGGACTATGAAGATTTCTTTCCGGTGCTGCCGACCCCGG

AACTGCTGAAGACCTACCAGAACGACGAGTATTTCGCGGAACAACGTCTGAGCGGTGTGAACCCGATGGTTA

TCCGTAGCATTAAAGAGCTGGACGCGCGTTTCGCGTTTAGCATCCGTGATCTGCAGGCGGAATTCGGCACCAG

CCTGAACCTGGAGCAAGAACTGAACAACGGCAACCTGTACATTTGCGACTATACCAGCCTGAGCTTTGTTCGT

GGTGGCAGCTACCTGCGTGGTCGTAAGAGCCTGCCGGCGCCGATTGCGCTGTTCTGCTGGCGTAACAGCGGT

TATTGCGATCGTGGCGAGCTGACCCCGATCGCGATTCAACTGGTGCCGGAACTGGGCACCGGTAGCCGTATTC

TGACCCCGTTTGACAGCCACCTGAACTGGCTGTACGCGAAAATCTGCATGCAAATTGCGGATGCGAACCACCA

CGAGATGAGCAGCCACCTGTGCCACACCCACCTGGTGATGGAGCCGTTTGCGGTTTGCACCGCGCGTCAGCT

GGCGGAAAACCACCCGCTGGGTCTGCTGCTGCGTCCGCACTTCCGTTTTATGCTGCACAACAACAGCCTGGCG

CGTAAGAACCTGATCAACCAGGGTGGCTACGTTGACAACCTGCTGGGTGGCACCCTGCGTGAGAGCCTGCAA

ATTGTGCGTGACGCGTATTTCAAGAACGCGGAGGAATTTTGGAGCCTGGATGAGTTCGCGCTGCCGAAAGAA

ATCGCGAACCGTGGTCTGGACGATACCGATCGTCTGCCGCACTACCCGTATCGTGACGATGGCATGCTGCTGT

GGAACGCGATTGAAAAGTTTGTTAGCAACTACCTGAGCATCTACTATCCGAACCCGGGTGACATTAAAGATGA

TCGTGAGCTGCAAGCGTGGGCGGCGGAATGCGTGGCGGCGGATGGTGGCCGTGTGAAGGGCGTTCCGAGC

CAATTTGAGAACCTGCAGCAACTGATCGACGTGGTTACCGGTATCATTTTTACCTGCGGTCCGCAGCACAGCG

CGGTGAACTACCCGCAATACGAATATATGGCGTTTGTTCCGAACATGCCGCTGGCGGGTTATCAGGCGGTGG

ACAGCAACCCGAACATGGATCTGAAAAGCCTGATGGCGTTCCTGCCGCCGCCGAACCAAACCGCGGACCAGC

TGCAAATCATTTACGGTCTGAGCGCGTACCGTTATGATCGTCTGGGCTACTATGACCGTGAGTTTAGCGATCC

GCACGCGGAGGAAGTGGTTCGTCTGTTCCAGCAAGATCTGAACCAGGTTGAGCGTAAGATCGAACTGCGTAA

CAAAAACCGTCTGGTGGAATATAACTTCCTGAAACCGAGCCTGGTTCTGAACAGCATCAGCATTTAA

Amino acid sequence for WP_027843955.1mut

SEQ ID NO: 278

MKPCLPQNDPNPEKRKDWLNKNREEYQFNFNYLSPLPLIDDVPNNEAFSPKYLAERLPLTFGKLSANTLGIRLRSFW

DPFDEFQDYEDFFPVLPTPELLKTYQNDEYFAEQRLSGVNPMVIRSIKELDARFAFSIRDLQAEFGTSLNLEQELNNG

NLYICDYTSLSFVRGGSYLRGRKSLPAPIALFCWRNSGYCDRGELTPIAIQLVPELGTGSRILTPFDSHLNWLYAKICM

QIADANHHEMSSHLCHTHLVMEPFAVCTARQLAENHPLGLLLRPHFRFMLHNNSLARKNLINQGGYVDNLLGGT

LRESLQIVRDAYFKNAEEFWSLDEFALPKEIANRGLDDTDRLPHYPYRDDGMLLWNAIEKFVSNYLSIYYPNPGDIK

DDRELQAWAAECVAADGGRVKGVPSQFENLQQLIDVVTGIIFTCGPQHSAVNYPQYEYMAFVPNMPLAGYQAV

DSNPNMDLKSLMAFLPPPNQTADQLQIIYGLSAYRYDRLGYYDREFSDPHAEEVVRLFQQDLNQVERKIELRNKNR

LVEYNFLKPSLVLNSISI

Codon-optimized coding sequence of WP_073641301.1mut

SEQ ID NO: 279

ATGAAACCGTGCCTGCCGCAGAACGACCCGGATCCGATTAAGCGTAAATACAGCCTGGAGCACAAGAAAGAG

GAATATGAATTCGACCACGATTTTCTGAGCCCGATGGCGATGCTGAAAGACGTGCCGGCGGTTGAGAACTTC

AGCACCCGTTACATTGCGGAACGTACCGTGGAGACCGCGGAACTGCCGATCAACATGCTGGCGGTTAAGACC

-continued

CGTGCGCTGTGGGACCCGCTGGATGAGCTGCAGGACTACGAAGATTATTTCCCGGTGCTGCCGAAGCCGAAC

GTTATCAAAACCTACCAGACCGACGATAGCTTTTGCGAGCAACGTCTGTGCGGTGCGAACCCGATGGCGCTGC

AGCAAATCAAAGAGATGGACGCGCGTTTCGAATTTACCATTGAGGAACTGCAGGAGAAATTCGGTGAAAGCA

TCAACCTGGTGGAGAAGCTGGCGGACGGCAACCTGTACGTGTGCGATTATCGTCCGCTGAGCTTTGTTAAGG

GTGGCACCTACGAACGTGGTAAGAAATATCTGCCGACCCCGCTGGCGTTCTTTTGCTGGCGTAGCAGCGGTTT

CAGCGATCGTGGCCAGCTGGTGCCGATCGCGATTCAACTGAACCCGGCGGTTGGCCGTCAGAGCCAACTGAT

TACCCCGTTCGACGATCCGCTGACCTGGTTTCACGCGAAACTGTGCGTGCAGATCGCGGACGCGAACCACCAC

GAGATGAGCAGCCACCTGTGCCGTACCCACTTCGTTATGGAACCGTTTGCGATTTGCACCGCGCGTCAACTGG

CGGATAACCACCCGCTGAACCTGCTGCTGAAACCGCACTTCCGTTTTATGCTGGCGAACAACAGCCTGGGTCG

TAAGCGTCTGGTGAACCGTGGTGGCCCGGTTGATGAGCTGCTGGCGGGCACCCTGCAGGAAAGCCTGCAAAT

TGTGGTTAACGCGTACAAAGAGTGGAGCCTGGATGAATTCGCGCTGCCGACCGAAATCAAGAACCGTGGTAT

GGACGATAAGCTGAAACTGCCGCACTACCCGTATCGTGACGATGGCATGCTGCTGTGGAACGCGATTAAGAA

ATTTGTGAGCGAGTATCTGAAGCTGTACTATAAAACCCCGCAGGACCTGACCGCGGATCTGGAACTGCAGGC

GTGGGCGCAAGAGTGCGTTAGCGAAAGCGGTGGCCGTGTGAAAGGTGTTCCGAGCCGTATCGAGAAGCTGG

AACAACTGGTGGACATCGCGACCGCGGTTATTTTTACCTGCGGTCCGCAGCATGCGGCGGTTAACTACAGCCA

ATACGAGTATATGACCTTTATGCCGAACATGCCGCTGGCGGCGTATAAGCAGATGACCGCGGAAGGCACCAT

CGCGGATCGTAAAAGCCTGCTGAGCTTCCTGCCGCCGAGCAAGCAGACCGCGGACCAACTGAGCATCCTGTTT

ATTCTGAGCGCGTACCGTTATGATCGTCTGGGCTACTATGACGATAAATTCGCGGACCCGGAGGCGCAAGATA

TTCTGGTGACCTTTCAGCAAGACCTGAACGAGGTTGAGCGTAAGATCGAACTGAACAACAAGAGCCGTCTGA

TTAAATACAACTATCTGAAGCCGCGTCTGGTGACCAACAGCATCAGCGTTTAA

Amino acid sequence for WP_073641301.1mut

SEQ ID NO: 280

MKPCLPQNDPDPIKRKYSLEHKKEEYEFDHDFLSPMAMLKDVPAVENFSTRYIAERTVETAELPINMLAVKTRALW

DPLDELQDYEDYFPVLPKPNVIKTYQTDDSFCEQRLCGANPMALQQIKEMDARFEFTIEELQEKFGESINLVEKLAD

GNLYVCDYRPLSFVKGGTYERGKKYLPTPLAFFCWRSSGFSDRGQLVPIAIQLNPAVGRQSQLITPFDDPLTWFHAK

LCVQIADANHHEMSSHLCRTHFVMEPFAICTARQLADNHPLNLLLKPHFRFMLANNSLGRKRLVNRGGPVDELA

GTLQESLQIVVNAYKEWSLDEFALPTEIKNRGMDDKLKLPHYPYRDDGMLLWNAIKKFVSEYLKLYYKTPQDLTADL

ELQAWAQECVSESGGRVKGVPSRIEKLEQLVDIATAVIFTCGPQHAAVNYSQYEYMTFMPNMPLAAYKQMTAEG

TIADRKSLLSFLPPSKQTADQLSILFILSAYRYDRLGYYDDKFADPEAQDILVTFQQDLNEVERKIELNNKSRLIKYNYLK

PRLVTNSISV

Codon-optimized coding sequence of WP_096647440.1mut

SEQ ID NO: 281

ATGAAACCGTGCCTGCCGCAGAACGACCCGGAGCCGACCCAGCGTAAGAACTTCCTGGAACGTAAACAGGGC

GAGTACGAATTCGATCACAAGTTTCTGAAACCGATGGCGATGCTGAAGAACGTGCCGAGCATTGAGAACTTT

AGCACCAAATATATCGCGGAACGTACCGTGGAGACCGCGGAACTGCCGCTGAACATGCTGGCGGTTAAAACC

CGTAGCCTGTGGGACCCGCTGGATGAGCTGCAGGACTACGAAGATTATTTCCCGGTGCTGCCGAAGCCGAAC

GTTATCAAAACCTACCAGACCGACAACAGCTTTTGCGAGCAACGTCTGTGCGGTGCGAACCCGCTGGTTCTGC

GTCAGATTCAGCAAATGGATGCGCGTTTCGCGTTTACCATCAGCGAGCTGCAAGAAAAGTTCGGTGACAGCAT

TGATCTGGAGGAACGTCTGAAAACCGGCAACCTGTACGTGTGCGACTATCGTGCGCTGGCGTTTGTTAAGGG

TGGCACCTACGAGCGTGGTAAGAAATATCTGCCGACCCCGATCGCGTTCTTTTGCTGGCGTAGCAGCGGTTTC

AGCGATCGTGGCCAGCTGGTGCCGATCGCGATTCAAATCAACCCGACCGACGGCAAGCAGAGCCAACTGATC

ACCCCGTTCGATGAACCGCTGGTGTGGTTTCACGCGAAACTGTGCGTTCAGATTGCGGACGCGAACCACCACG

AGATGAGCAGCCACCTGTGCCGTACCCACTTCGTTATGGAACCGTTTGCGATTTGCACCGCGCGTCAGCTGGC

-continued

GGATAACCACCCGCTGAACCTGCTGCTGAAGCCGCACTTCCGTTTTATGCTGGCGAACAACAGCCTGGGTCGT
CAACGTCTGGTGAACCGTGGTGGCCCGGTTGATGAGCTGCTGGCGGGCACCCTGCAGGAAAGCCTGCAAATC
GTGGTTAACGCGTACAAAGAGTGGAGCCTGGATCAGTTCAGCCTGCCGACCGAACTGAAGAACCGTGGTATG
GACAACAGCGATAAACTGCCGCACTACCCGTATCGTGACGATGGCCTGCTGCTGTGGAACGCGATTAAGAAA
TTCGTGAGCGAATACCTGAAGCTGTACTATAAAACCCCGCAAGACCTGACCGCGGATTTTGAGCTGCAGAGCT
GGGCGCAAGAATGCGTTAGCCAGAGCGGTGGCCGTGTGAAAGGTGTTAGCGACCGTATCACCACCCTGGACC
AACTGATTGATATCGCGACCGCGGTGATTTTTACCTGCGGTCCGCAGCATGCGGCGGTTAACTACAGCCAATA
CGAGTATATGACCTTTATCCCGAACATGCCGCTGGCGGCGTATAAGCAGATTACCAGCGAGGGTAACATCCCG
GACCGTAAGAGCCTGCTGAGCTTCCTGCCGCCGAGCAAACAGACCGCGGATCAACTGAGCATTCTGTTTATCC
TGAGCGCGTACCGTTATGACCGTCTGGGCTACTATGACGATAAATTCCTGGATCCGGAGGCGCAGGAAATCCT
GGTGACCTTTCAGCAAGAGCTGAACGAGGCGGAACGTCAAATTGAACTGAACAACAAGAGCCGTCTGATCAA
CTACGACTATCTGAAACCGCGTCTGGTGACCAACAGCATTAGCGTTTAA

Amino acid sequence for WP_096647440.1mut

SEQ ID NO: 282

MKPCLPQNDPEPTQRKNFLERKQGEYEFDHKFLKPMAMLKNVPSIENFSTKYIAERTVETAELPLNMLAVKTRSLW
DPLDELQDYEDYFPVLPKPNVIKTYQTDNSFCEQRLCGANPLVLRQIQQMDARFAFTISELQEKFGDSIDLEERLKTG
NLYVCDYRALAFVKGGTYERGKKYLPTPIAFFCWRSSGFSDRGQLVPIAIQINPTDGKQSQLITPFDEPLVWFHAKLC
VQIADANHHEMSSHLCRTHFVMEPFAICTARQLADNHPLNLLLKPHFRFMLANNSLGRQRLVNRGGPVDELLAG
TLQESLQIVVNAYKEWSLDQFSLPTELKNRGMDNSDKLPHYPYRDDGLLLWNAIKKFVSEYLKLYYKTPQDLTADFE
LQSWAQECVSQSGGRVKGVSDRITTLDQLIDIATAVIFTCGPQHAAVNYSQYEYMTFIPNMPLAAYKQITSEGNIP
DRKSLLSFLPPSKQTADQLSILFILSAYRYDRLGYYDDKFLDPEAQEILVTFQQELNEAERQIELNNKSRLINYDYLKPRL
VTNSISV

Codon-optimized coding sequence of WP_099099431.1mut

SEQ ID NO: 283

ATGAAACCGTGCCTGCCGCAGAAAGACCCGGATGTTAAAGTGCGTATCAACTGGCTGGACAAAAACCGTGAG
GAATACAAGTTCAACTACGACTATCTGGCGCCGCTGCCGGTTATCGATAAAGTGCCGCACAAGGAGATTTTTA
GCGCGGAATATACCACCAAACGTCTGGCGAGCATGGCGAGCCTGGCGCCGAACATGCTGGCGGCGAAGGCG
CGTAACTTCCTGGACCCGCTGGATGAGCTGGAGGAATACGAGGAACTGCTGAGCCTGCTGCCGAAGCCGGAC
GTTATCAAGAACTATAAAACCGATAGCTGCTTTGCGGAACAACGTCTGAGCGGTGCGAACCCGCTGGCGATCC
AAAAAATTGACGTTCTGGATGCGCGTTTCGCGGTGACCGACGCGCACTTTCAGAAGGTGGCGGGCACCGAGT
TCACCCTGGAAAAGGCGCTGAAAGAGGGCAAGCTGTACTTTTGCGACTATCCGCTGCTGAGCGATATCAAAG
GTGGCGTTTACAACAACGTGAAGAAATATCTGCCGAAGCCGCAGGCGCTGTTCTACTGGCAAAGCAACGACA
GCCCGAACGGTGGCAGCCTGGTTCCGGTGGCGATCCAGATTAACCACGATAGCGGTGGCAAAAGCGTTATCT
ATACCCCGGACGATCCGCACCTGGACTGGTTTCTGGCGAAGACCTGCGTGCAGATTGCGGATGGTAACCACC
AAGAGCTGGGCAGCCACTTCGCGTACACCCACGCGGTTATGGCGCCGTTTGCGATCTGCACCGCGCGTCAACT
GGCGGAAAACCACCCGATTGCGCTGCTGCTGAAACCGCACTTCCGTTTTATGCTGTTCGACAACAGCCTGGGT
CGTACCCAGTTTCTGCAACCGGGTGGCCCGGTTGATGAGTTCATGGCGGGTAGCCTGGCGGAAAGCCTGGGC
TTTGTTGCGAAGGTGTACGAGGAATGGAGCGTGGAGAAATTCACCTTTCCGCGTCTGATCAAGAGCCGTCGT
ACCGACGATCCGGAAATTCTGCCGCACTTCCCGTTTCGTGACGATGGTATGCTGATCTGGAACGCGGTTGAGA
AATTCGTGTACGAATATCTGCAGCTGTACTATAAGACCAGCCAAGACCTGATTGACGATTATGAGCTGCAGAA
CTGGGCGCGTGAATGCGTTGCGCAAGATGGTGGCCGTGTGAAAGGCATGCCGGCGAAGATCGAGACCCTGG
AACAGCTGATTGAGATCATTAGCGTGGTTGTTTTTACCTGCGCGCCGCTGCACAGCGCGCTGAACTTCAGCCA

-continued

ATACGAATATATGGCGTTTGTTCCGAACATGCCGTACGCGGCGTATCACCCGATCCCGGAGACCAAAGGTGTG
GACCTGGAAACCATCATGAAAATTCTGCCGCCGTTCAAGCAGGCGGCGGACCAAGTGATGTGGACCGAGATT
CTGACCAGCTACCACTATGATAAGCTGGGCTTCTACGACGAGGAATTTGCGGATCCGCTGGCGCAGGAAATC
GTTGTGCAATTCCAGCAAAACCTGCACGAGATTGAACGTCAGATCGATATTCGTAACCAAACCCGTCCGATCC
CGTACAACTATTTTAAACCGAGCCAGATCATTAACAGCATTAACACCTAA

Amino acid sequence for WP_099099431.1mut

SEQ ID NO: 284

MKPCLPQKDPDVKVRINWLDKNREEYKFNYDYLAPLPVIDKVPHKEIFSAEYTTKRLASMASLAPNMLAAKARNFL
DPLDELEEYEELLSLLPKPDVIKNYKTDSCFAEQRLSGANPLAIQKIDVLDARFAVTDAHFQKVAGTEFTLEKALKEGK
LYFCDYPLLSDIKGGVYNNVKKYLPKPQALFYWQSNDSPNGGSLVPVAIQINHDSGGKSVIYTPDDPHLDWFLAKT
CVQIADGNHQELGSHFAYTHAVMAPFAICTARQLAENHPIALLLKPHFRFMLFDNSLGRTQFLQPGGPVDEFMAG
SLAESLGFVAKVYEEWSVEKFTFPRLIKSRRTDDPEILPHFPFRDDGMLIWNAVEKFVYEYLQLYYKTSQDLIDDYEL
QNWARECVAQDGGRVKGMPAKIETLEQLIEIISVVVFTCAPLHSALNFSQYEYMAFVPNMPYAAYHPIPETKGVDL
ETIMKILPPFKQAADQVMWTEILTSYHYDKLGFYDEEFADPLAQEIVVQFQQNLHEIERQIDIRNQTRPIPYNYFKPS
QIINSINT

Codon-optimized coding sequence of WP_052672367.1mut

SEQ ID NO: 285

ATGAAACCGTGCCTGCCGCAACATGAGCCGGATGCGATTGCGCGTCAGAACCGTCTGATTAAAAACCGTGCG
GACTACGTGCTGGATTACAACTATCTGCCGCCGATCCCGCTGCAGACCCCGGTTCCGCAGCAAGAGCGTTTCA
GCGCGGAATATACCGCGCGTCGTCTGGCGAGCTTTGCGAACCTGGTGCCGAACATGCTGATGGCGCGTGCGC
GTAACGCGTTTGACCCGCTGGATACCCTGGAGGAATATGCGGACCTGCTGCCGGTGCTGCCGAAGCCGAACG
TTATTAAAAACTATCAAGCGGATTGGTGCTTCGCGGAGCAGCGTCTGAGCGGTATCAACCCGCCGGCGATCCG
TCGTATTGACGCGCTGGATGCGCGTCTGCCGATTAGCAACAGCAGCTTTCAACACAGCGTTGGCGCGGAGCA
CAACCTGGAACAGGCGCTGAAGGAAGGTAAACTGTACTGCTGCGACTATCCGCTGCTGAGCGGCATCGGTGG
CGGTAACTACCAAAACCTGCCGAAGTATCTGCCGAAACCGCAGGCGCTGTTTTACTGGCGTAGCGATAACAGC
AAGATTGGCGGTAGCCTGGTGCCGGTTGCGATCAAGATTCTGAACGAGCTGGGCGGTAAAAACCTGGTGTAC
ACCCCGAACGACGCGCCGCTGGATTGGTTCCTGGCGAAGACCTGCGTTCAGATGGCGGACGCGAACCACCAA
GAACTGGGCACCCACTTTGCGAAAACCCACGCGGTTATGGCGCCGATTGCGGCGTGCACCGCGCGTGAGCTG
GGTGAAAACCACCCGCTGACCCTGCTGCTGAAACCGCACTTCCGTTTTATGCTGTTCGATAACAGCCTGGGTC
GTACCCAGTTTCTGCAACCGACCGGTCCGACCGAGGAACTGCTGGCGGGCACCCTGGAGGAAAGCGTTCAGC
TGGTTGTGCAAGCGTACGAGGAATGGAGCATCGACACCACCTTCCCGCTGGAGCTGCAGCAACGTCAAATGC
ACGATCCGGAAATTCTGCCGCACTATCCGTTCCGTGACGATGGCATCCTGGTGTGGAACGCGATTCACCAGTT
TGTTACCGAATACCTGCAAATTTACTATCACACCCCGCAGGACATCAGCGCGGATTATGAGGTGCAGAACTGG
GCGCGTGAATGCGTGGACAGCGGTCGTGTTAAGGGTATGCCGGAGAGCATCGACACCCTGGCGCAACTGATT
GATATCATTGCGGTGGTTATCTTCACCTGCGCGCCGCTGCACAGCTGCCTGAACCTGGCGCAGTACGAATATA
TGACCTTTGTTCCGAACATGCCGTACGCGGCGTATCACCCGATCCCGACCACCAAGGGTGTGGATATGGCGAC
CATCGTTAAAATTATGCCGCCATTCCAGCGTGCGATCGACCAAATTCTGTGGACCGATATTCTGAGCGCGTTTC
AATACGACAAGCTGGGCTTCTATGAGGAAGACTTTGCGGATCCGAAAGCGCAGGAAGTGCTGCAGCGTTTCC
AAGATAACCTGCAGCAAGTTGAGGAAAAGATCGAAATGCACAACCAGATCCGTCCGATTCCGTACAACTATCT
GAAACCGAGCCGTATCATGAACAGCATTAACACCTAA

Amino acid sequence for WP_052672367.1mut

SEQ ID NO: 286

MKPCLPQHEPDAIARQNRLIKNRADYVLDYNYLPPIPLQTPVPQQERFSAEYTARRLASFANLVPNMLMARARNA
FDPLDTLEEYADLLPVLPKPNVIKNYQADWCFAEQRLSGINPPAIRRIDALDARLPISNSSFQHSVGAEHNLEQALKE

-continued

GKLYCCDYPLLSGIGGGNYQNLPKYLPKPQALFYWRSDNSKIGGSLVPVAIKILNELGGKNLVYTPNDAPLDWFLAK
TCVQMADANHQELGTHFAKTHAVMAPIAACTARELGENHPLTLLLKPHFRFMLFDNSLGRTQFLQPTGPTEELLA
GTLEESVQLVVQAYEEWSIDTTFPLELQQRQMHDPEILPHYPFRDDGILVWNAIHQFVTEYLQIYYHTPQDISADYE
VQNWARECVDSGRVKGMPESIDTLAQLIDIIAVVIFTCAPLHSCLNLAQYEYMTFVPNMPYAAYHPIPTTKGVDM
ATIVKIMPPFQRAIDQILWTDILSAFQYDKLGFYEEDFADPKAQEVLQRFQDNLQQVEEKIEMHNQIRPIPYNYLKP
SRIMNSINT

Codon-optimized coding sequence of WP_073631249.1mut SEQ ID NO: 287

ATGAAACCGTGCCTGCCGCAGCATGACCCGAACCCGGAAGCGCGTCGTAACTGGCTGGAACAAAACCGTGAG
GACTACAAGTTTGATCACAACTATCTGGCGCCGATCCCGATTCTGGACAAGGTTCCGCACAAAGAGCTGTTCA
GCCCGCAGTACACCGCGAAACGTCTGGCGAGCATGGCGGATCTGGTGCCGAACATGCTGGCGGCGAAGGCG
CGTAACTTCTTTGACCCGCTGGATGAACTGGAGGAATACGAGGCGCTGCTGAGCATTCTGCCGAAACCGAGC
GTTATCAAGAACTATAAAACCGACAGCTGCTTTGCGGAACAGCGTCTGAGCGGTGCGAACCCGATGGCGATG
CACCGTATTGACGAGCTGGATGCGCGTTTCCCGGTTACCAACGATCACTTTCAAAAGGCGGTGGGTGCGGAA
CACAACCTGGAGGCGGCGCTGAAGGAAGGCAAACTGTACCTGTGCGACTATCCGCTGCTGTTTGATATTAAG
GGTGGCACCTACCAGAACATCAAGAAATATCTGCCGAAACCGCAGGCGCTGTTCTACTGGCAAAGCAACGGT
AACAAGAACAGCGGCAGCCTGGTGCCGATCGCGATTCAAATCCACAACGACACCGGTGGCGATAGCCTGATT
TATACCCCGGACGATCCGCACCTGGACTGGTTCCTGGCGAAAACCTGCGTTCAGATCGCGGATGCGAACCACC
AAGAACTGGGTAGCCATTTTGCGCGTACCCATGCGGTGATGGCGCCGTTTGCGATCTGCACCGCGCGTCAACT
GGGTGAAAACCACCCGCTGGCGCTGCTGCTGAAACCGCACTTCCGTTTTATGCTGTACGACAACAGCCTGGGT
CGTACCCACTTCCTGCAGGCGGGTGGCCCGGTTGATGAATTTATGGCGGGCACCCTGCAAGAGAGCCTGGGC
TTTGTGGCGAAGGCGTACGAGGAATGGAGCCTGGACAACGCGGTTTTCCCGACCGAGGTGAAGAACCGTAA
AATGGACGATCCGGACATTCTGCCGCACTATCCGTTTCGTGACGATGGTATGCTGCTGTGGGATGCGGTTAAG
AAATTCGTGACCGAATACCTGCAGCTGTACTATAAGACCCCGCAAGACCTGAGCGAGGATTATGAACTGCAAA
ACTGGGCGCGTGAGTGCGCGGCGCAAGACGGTGGCTGCGTTAAGGGCATGCCGGAGAAAATTGAAACCATC
GAGCAGCTGATCCACGTGGTTACCGTGGTTGTGTTTACCTGCGCGCCGCTGCACAGCGCGCTGAACTTCAGCC
AATACGAATATATGGCGTTTGTTCCGAACATGCCGTACGCGGCGTACTATCCGGTTCCGGAGACCAAAGGTGT
GGATATGCAGACCATTATGAAGATGCTGCCGCCGTTCAAACAGGCGGCGGACCAAGTGATGTGGAGCGATAT
CCTGACCAGCTTCCACTACGACAAGCTGGGCCACTATGATGAGGAATTTGCGAACCCGATGGCGCAGGCGAT
CCTGCTGCAATTCCAGCAAAACCTGCACGAGGTGGAACGTCAGATTGAAATCAAGAACCAAAGCCGTCCGATT
CCGTACAACTATCTGAAACCGAGCGAGATCATTAACAGCATCAACACCTAA

Amino acid sequence for WP_073631249.1mut SEQ ID NO: 288

MKPCLPQHDPNPEARRNWLEQNREDYKFDHNYLAPIPILDKVPHKELFSPQYTAKRLASMADLVPNMLAAKARN
FFDPLDELEEYEALLSILPKPSVIKNYKTDSCFAEQRLSGANPMAMHRIDELDARFPVTNDHFQKAVGAEHNLEAAL
KEGKLYLCDYPLLFDIKGGTYQNIKKYLPKPQALFYWQSNGNKNSGSLVPIAIQIHNDTGGDSLIYTPDDPHLDWFL
AKTCVQIADANHQELGSHFARTHAVMAPFAICTARQLGENHPLALLLKPHFRFMLYDNSLGRTHFLQAGGPVDEF
MAGTLQESLGFVAKAYEEWSLDNAVFPTEVKNRKMDDPDILPHYPFRDDGMLLWDAVKKFVTEYLQLYYKTPQD
LSEDYELQNWARECAAQDGGCVKGMPEKIETIEQLIHVVIVVVFTCAPLHSALNFSQYEYMAFVPNMPYAAYYPV
PETKGVDMQTIMKMLPPFKQAADQVMWSDILTSFHYDKLGHYDEEFANPMAQAILLQFQQNLHEVERQIEIKN
QSRPIPYNYLKPSEIINSINT

-continued

Codon-optimized coding sequence of WP_013220336.1mut

SEQ ID NO: 289

ATGAACACCTGCCTGCCGCAGAACGACAGCGATCCGCAAGGTCGTAAGGATCGTCTGGAACGTCGTCGTGCG

CTGTACGTGTTCAACTACGATTATGTTCCGCCGATCCCGATGATTGACAAGGTTCCGCACGAGGAATACTTTAG

CCCGAAATATACCGCGGAGCGTCTGGCGAGCATGGCGAAACTGGCGCCGAACATGCTGGCGGCGAAGACCA

AACGTCTGTTCGATCCGCTGGACGAGCTGAACGAATACGATGAGATGTTCATCTTTCTGGACAAGCCGGGTAT

TGTTCGTGGCTATCGTACCGACGAAAGCTTCGGCGAGCAGCGTCTGAGCGGCGTGAACCCGATGAGCATCCG

TCGTCTGGATAAACTGGACGCGCGTTTTCCGATTATGGATGAATACCTGGAGCAGAGCCTGGGTAGCCCGCAC

ACCCTGGCGCAGGCGCTGCAAGAAGGCCGTCTGTACTTCTGCGACTATCCGCAACTGGCGCACGTTAAAGAG

GGTGGTCTGTACCGTGGTCGTAAGAAATATCTGCCGAAACCGCGTGCGCTGTTTTGCTGGGATGGTAACCACC

TGCAGCCGGTGGCGATCCAGATTAGCGGCCAACCGGGTGGCCGTCTGTTCATTCCGCGTGACAGCGATCTGG

ACTGGTTTGTGGCGAAGCTGTGCGTTCAGATCGCGGACGCGAACCACCAAGAACTGGGCACCCACTTCGCGC

GTACCCACGTGGTTATGGCGCCGTTTGCGGTTTGCACCCATCGTCAGCTGGCGGAGAACCACCCGCTGCACAT

TCTGCTGCGTCCGCACTTCCGTTTTATGCTGTACGATAACAGCCTGGGTCGTACCCGTTTCATCCAGCCGGATG

GTCCGGTGGAACACATGATGGCGGGCACCCTGGAGGAAAGCATCGGCATTAGCGCGGCGTTCTACAAGGAA

TGGCGTCTGGATGAGGCGGCGTTTCCGATCGAGATTGCGCGTCGTAAAATGGACGATCCGGAAGTTCTGCCG

CACTACCCGTTCCGTGACGATGGTATGCTGCTGTGGGACGGCATTCAGAAGTTTGTTAAAGAGTATCTGGCGC

TGTACTATCAAAGCCCGGAAGATCTGGTGCAGGACCAAGAGCTGCGTAACTGGGCGCGTGAATGCACCGCGA

ACGATGGTGGCCGTGTGGCGGGTATGCCGGGTCGTATCGAAACCGTTGACCAGCTGACCAGCATCCTGAGCA

CCGTGATTTATACCTGCGCGCCGCTGCACAGCGCGCTGAACTTTGCGCAATACGAGTATATCGGTTATGTTCCG

AACATGCCGTACGCGGCGTATCACCCGATTCCGGAGGAAGGTGGCGTGGATATGGAGACCCTGATGAAGATT

CTGCCGCCGTACGAACAGGCGGCGCTGCAACTGAAATGGACCGAGATCCTGACCAGCTACCACTATGACCGT

CTGGGCCACTATGATGAAAAGTTCGAGGACCCGCAGGCGCAAGCGGTGGTTGAACAGTTTCAGCAAGAGCTG

GCGGCGGTGGAGCAAGAAATTGATCAGCGTAACCAAGACCGTCCGCTGGCGTACACCTATCTGAAACCGAGC

GAAATCATTAACAGCATCAACACCTAA

Amino acid sequence for WP_013220336.1mut

SEQ ID NO: 290

MNTCLPQNDSDPQGRKDRLERRRALYVFNYDYVPPIPMIDKVPHEEYFSPKYTAERLASMAKLAPNMLAAKTKRL

FDPLDELNEYDEMFIFLDKPGIVRGYRTDESFGEQRLSGVNPMSIRRLDKLDARFPIMDEYLEQSLGSPHTLAQALQ

EGRLYFCDYPQLAHVKEGGLYRGRKKYLPKPRALFCWDGNHLQPVAIQISGQPGGRLFIPRDSDLDWFVAKLCVQI

ADANHQELGTHFARTHVVMAPFAVCTHRQLAENHPLHILLRPHFRFMLYDNSLGRTRFIQPDGPVEHMMAGTLE

ESIGISAAFYKEWRLDEAAFPIEIARRKMDDPEVLPHYPFRDDGMLLWDGIQKFVKEYLALYYQSPEDLVQDQELRN

WARECTANDGGRVAGMPGRIETVDQLTSILSTVIYTCAPLHSALNFAQYEYIGYVPNMPYAAYHPIPEEGGVDME

TLMKILPPYEQAALQLKWTEILTSYHYDRLGHYDEKFEDPQAQAVVEQFQQELAAVEQEIDQRNQDRPLAYTYLKP

SEIINSINT

SEQUENCE LISTING (290 sequences)

SEQ ID NO: 1 - DNA, 2745 bp, Cladophora oligoclada
atgacgtcgtctccgaccgtcagatcgatggtaatgctggccgtgctggccgtctctgccctggagagcgcgccctgcgcctcggcctttgccacgctcccccgcgccctcgtacgaccgcaagccgccctcaagtaccgagccgaggacaaaaatgacgtcgatgtcgccccggctggtagcactgcctccgacgtgagcaagcccgaaggcaaggccaccgccgtcgccaagggtactgtcaacgcgcccatcgaggaggcatggaaggtcttccggtctttttccaacatgaaccaatggatgcccgtgtacggcgagtgggaggccacgggagactcagtcggagacacccgcacgttcaacttcaaggatcagccgaccttcttcactaccgagaggcttgtcggcctggacgactcccagtacaagatgaagtacaccctcgtcaactgcaagggctcgcccgtgcccatcgaatctatcgacaccatcgtcaccttcactgcaaacgatgatgtgaccgaggttgactggcgctcctggacgaagtcgcccatggtcgacttgatcaagggacgtcaggcggccgggtatgccggcggcatcgcagcgctcgaccggtacctgaacccgtcccttggcaccgtcgatgtcaccatcaagtcggccgacaacctcgatggtgatttcctgtccagctcctacgccactctcatggtcacggacgccgaccccgagcaagtgcatgccaaggagtgggggacgagtcctgagtttgatgccaagcccgtccagttcagcctgctcaagcccgactccaagctctacatgagcgtcatgctgaccaagtgcggcgtcgacgcccccgtcggatacgccgtctttgacatccagaagagcctcaagtccggcgagactgtgaccgagacctttcagctcgagggcagcaacgatgcaacgttgacggtcgagatggagctcaacctccggcagggcagcatcctccctcaatccaaggcccagaagaatctggcgacccttgtcgccctccagcagtctgtcgagagggtccgagaccgcatcgttactatcggcaagctggccggcgagcccgagaagtcggtatgggagtacgagcgaaagtccggccttcccaagtccgtcaagggccttcctcggtcggaagtgctgccgccgcacaagatcgccctcatggtcgacgccatcgccgagtacgcttacacccagttccagctcgtccagcgcctgctccccgtcagaaactcgtacgaccggtacgccgcttactttgccccagaaggcgaggagtacgttcccatcccgcagatcctcaaggacatgacgtggtccaccgatgacgagttcatccgccagatcttcgccggcctcaaccctttgcaagtcgaggtcgtcaagaacaaggccggtctgccctccaagttgcaggagctcaaggccagggacggatctgatgtcgataagctcatctcggaaggccggttgtatgttctggactactcggtcctcaaggatctcgacctcaaccgcaacggtgtcaccctgtacgcgccgacgatgctcatctaccgcactggtggtgacaagctcgacgtcctcggcatcatgctcgagccccgccgtgacgatgcgcccgtttacacgcccgactctgaaactcccaacaagttccttctcgccaagtgccacgttgcctgcgctgacaaccaagtgcaccagttcacgtaccatctcggttacgcccatcttgccacggagccacttgcgatcgcaagccacaacgtcctggagaagaacagccatccgctcggcatgttcctcaagccacacttccgcgacaacattggcatcaactacctcgcccggcagactcttgttgccgacgaagacgccatcacagaccacacctttgccacgggcaccgcgcagggcgtcagtatggtcgtcgacgccttcaagtcgtacaacttcctcgagtctggcttgcccgatgagctgcgccgtcgtggattcgaacggtcggacgacctcaaggtgtatcgctaccgcgacgatggctggttggtttgggacacgctctggaagtacgccgaggatatggtcaacgagctgtacggaacggacaacgatgtcactgctgacaaggtcgtccaggagtgggcgagggaagcatctggctcggacactgccgacgtccagggctttccggagtccatcacgaccaagtacatcctcacaaaggtcctgacgacgatcatctggcaagcgtccgccttgcactcggctctcaactacatccaatacccgtacactgcgacccccatcaaccgtgccgcctccatctttggaccggtccctgacggcgaagcggatatcaccgagcaggacatcctggatgtcatccctggtggtctggacgatgagaacaaccgtggtctgaccctctccatcttccaaggcctgctctcgtggctcctgcgcactcctgagaacccgacgctggacgaagtcggcagcccaatcccgaacaggaacaaccccatcgagtgggtcgagttccgctcgaagtacccccaggtctactacaacttggaccagaaccttgccgtggtggagaagatcatcgaggagcgcaacaagggccttgcttctccgtacgaggtgctccttcccagccacattgctgccagcatcaacatctga

SEQ ID NO: 2 - DNA, 2745 bp, Artificial Sequence
  Codon-optimized coding sequence of CoLOX-3
atgaccagcagcccgaccgtgcgtagcatggttatgctggcggttctggcggttagcgcgctggaaagcgcgccgtgcgcgagcgcgtttgcgaccctgccgcgtgcgctggttcgtccgcaggcggcgctgaagtatcgtgcggaagacaaaaacgatgttgatgttgcgccggcgggtagcaccgcgagcgatgttagcaagccggagggtaaagcgaccgcggttgcgaagggcaccgtgaacgcgccgatcgaggaagcgtggaaagtgttccgtagctttagcaacatgaaccaatggatgccggtttacggcgagtgggaagcgaccggtgacagcgtgggcgatacccgtaccttcaactttaaggaccagccgaccttctttaccaccgagcgtctggtgggtctggacgatagccaatataagatgaaatacaccctggttaactgcaaaggcagcccggtgccgatcgaaagcattgataccatcgttaccttcaccgcgaacgacgatgtgaccgaggttgactggcgtagctggaccaagagcccgatggtggatctgattaaaggtcgtcaagcggcgggttatgcgggtggcattgcggcgctggaccgttacctgaacccgagcctgggcaccgtggacgttaccatcaagagcgcggataacctggacggcgatttcctgagcagcagctacgcgaccctgatggttaccgatgcggatccggagcaggtgcatgcgaaggaatggggcaccagcccggagttcgacgcgaaaccggttcaatttagcctgctgaagccggatagcaaactgtatatgagcgtgatgctgaccaaatgcggtgtggatgcgccggttggttatgcggtgttcgatattcagaagagcctgaaaagcggcgagaccgttaccgaaacctttcaactggaaggcagcaacgacgcgaccctgaccgtggagatggaactgaacctgcgtcagggtagcatcctgccgcagagcaaggcgcagaagaacctggcgaccctggttgcgctgcagcaaagcgtggagcgtgttcgtgaccgtattgttaccatcggtaaactggcgggtgaaccggagaagagcgtgtgggagtatgagcgtaagagcggtctgccgaagagcgttaaaggtctgccgcgtagcgaagtgctgccgccgcacaaaattgcgctgatggttgacgcgatcgcggagtacgcgtatacccagttccaactggttcagcgtctgctgccggtgcgtaacagctacgaccgttatgcggcgtactttgcgccggaaggcgaggaatacgtgccgattccgcaaatcctgaaggatatgacctggagcaccgacgatgagttcattcgtcagatctttgcgggtctgaacccgctgcaagttgaagtggttaagaacaaagcgggtctgccgagcaagctgcaggagctgaaagcgcgtgacggtagcgacgtggataagctgatcagcgagggccgtctgtatgttctggattacagcgtgctgaaagacctggatctgaaccgtaacggtgttaccctgtatgcgccgaccatgctgatttaccgtaccggtggcgacaaactggatgttctgggcatcatgctggaaccgcgtcgtgacgatgcgccggtgtacaccccggacagcgagaccccgaacaagttcctgctggcgaaatgccacgttgcgtgcgcggataaccaggtgcaccaatttacctatcacctgggttatgcgcacctggcgaccgaaccgctggcgattgcgagccacaacgtgctggagaagaacagccacccgctgggcatgttcctgaaaccgcactttcgtgacaacatcggcattaactatctggcgcgtcagaccctggttgcggacgaagatgcgatcaccgatcatacctttgcgaccggcaccgcgcaaggcgtgagcatggtggttgacgcgttcaagagctacaactttctggaaagcggtctgccggatgagctgcgtcgtcgtggtttcgagcgtagcgacgatctgaaggtttaccgttatcgtgacgatggttggctggtgtgggacaccctgtggaaatatgcggaggatatggttaacgaactgtacggcaccgacaacgatgtgaccgcggacaaagtggttcaggagtgggcgcgtgaagcgagcggtagcgacaccgcggatgttcaaggcttcccggaaagcattaccaccaagtatatcctgaccaaagtgctgaccaccatcatttggcaagcgagcgcgctgcacagcgcgctgaactacattcaatacccgtataccgcgaccccgattaaccgtgcggcgagcatctttggtccggttccggacggcgaggcggatattaccgaacaggacattctggatgtgatcccgggtggcctggacgatgagaacaaccgtggtctgaccctgagcatcttccaaggtctgctgagctggctgctgcgtaccccggaaaacccgaccctggacgaggttggtagcccgattccgaaccgtaacaacccgatcgagtgggttgaatttcgtagcaagtatccgcaggtgtactataacctggatcaaaacctggcggtggttgaaaagatcattgaggaacgtaacaaaggtctggcgagcccgtacgaggtgctgctgccgagccacattgcggcgagcatcaacatttaa

SEQ ID NO: 3 - protein, 914 aa, Cladophora oligoclada
MTSSPTVRSMVMLAVLAVSALESAPCASAFATLPRALVRPQAALKYRAEDKNDVDVAPAGSTASDVSKPEGKATAVAKGTVNAPIEEAWKVFRSFSNMNQWMPVYGEWEATGDSVGDTRTFNFKDQPTFFTTERLVGLDDSQYKMKYTLVNCKGSPVPIESIDTIVTFTANDDVTEVDWRSWTKSPMVDLIKGRQAAGYAGGIAALDRYLNPSLGTVDVTIKSADNLDGDFLSSSYATLMVTDADPEQVHAKEWGTSPEFDAKPVQFSLLKPDSKLYMSVMLTKCGVDAPVGYAVFDIQKSLKSGETVTETFQLEGSNDATLTVEMELNLRQGSILPQSKAQKNLATLVALQQSVERVRDRIVTIGKLAGEPEKSVWEYERKSGLPKSVKGLPRSEVLPPHKIALMVDAIAEYAYTQFQLVQRLLPVRNSYDRYAAYFAPEGEEYVPIPQILKDMTWSTDDEFIRQIFAGLNPLQVEVVKNKAGLPSKLQELKARDGSDVDKLISEGRLYVLDYSVLKDLDLNRNGVTLYAPTMLIYRTGGDKLDVLGIMLEPRRDDAPVYTPDSETPNKFLLAKCHVACADNQVHQFTYHLGYAHLATEPLAIASHNVLEKNSHPLGMFLKPHFRDNIGINYLARQTLVADEDAITDHTFATGTAQGVSMVVDAFKSYNFLESGLPDELRRRGFERSDDLKVYRYRDDGWLVWDTLWKYAEDMVNELYGTDNDVTADKVVQEWAREASGSDTADVQGFPESITTKYILTKVLTTIIWQASALHSALNYIQYPYTATPINRAASIFGPVPDGEADITEQDILDVIPGGLDDENNRGLTLSIFQGLLSWLLRTPENPTLDEVGSPIPNRNNPIEWVEFRSKYPQVYYNLDQNLAVVEKIIEERNKGLASPYEVLLPSHIAASINI

SEQ ID NO: 4 - DNA, 2745 bp, Cladophora oligoclada
atgacgtcgtctccgaccgtcagatcgatggtaatgctggccgtgctggccgtctatgccctggagagcacgccctgcgcctcggcctttgccacgctcccccgcgccctcgtacgaccgcaagccgccctcaagtaccgagccgaggacaaaaacgacgtcgatgtcgccccggctggtagcactgcctccgacgtgagcaagcccgaaggcaaggccaccgccgtcgccaagggtacggtcaacgcgcccatcgaggaggcatggaaggtcttccggtctttttccaacatgaaccaatggatgcccgtgtacggcgagtgggaggccacgggagactccgtcggagacacccgcacgttcaacttcaaggatcagccgaccttcttcactaccgagaggcttgtcggcctggacgactcccagtacaagatgaagtacaccctcgtcaactgcaagggctcgcccgtgcccatcgaatctatcgacaccatcgtcaccttcactgcaaacgatgatgtgaccgaggttgactggcgctcctggacgaagtcgcccatggtcgacttgatcaagggacgccaggcggccgggtatgccggcggcatcgcagcgctcgaccggtacctgaacccgtcccttggcaccgtcgatgtcaccatcaagtcggccgacaacctcgatggcaatttcctgtccagctcctacgccactctcatggtcacggacgccgaccccgagcaagtgcatgccaaggagtgggggacgagtcctgagtttgatgccaagcccgtccagttcagcctgctcaagcccgactccaagctctacatgagcgtcatgctgaccaagtacggcgtcgacacgcccgtcggatacgccgtctttgacatccagaagagcctcaagtccggcgagactgtgaccgagacctttcagctcgagggcagcaacgatgcaacgttgacggtcgagatggagctcaacctccgacagggcagcgtcctccctcaatccaaggcccagaagaatctggcgacccttgtcgccctccagcagtctgtcgagagggtccgagaccgcatcgttactatcggcaagctggccggcgagcccgagaagtcggtatgggagtacgagcgaaagtccggccttcccaagtccgtcaagggccttcctcggtcggaagtgctgccgccgcacaagatcgccctcatggtcgacgccatcgccgagtacgcttacactcagttccagctcgtccagcgcctgctccccgtcagaaactcgtacgaccggtacgccgcttactttgccccagaaggcgaggaatacgttcccatcccgcagatcctcaaggacatgacgtggtccaccgatgacgagttcatccgccagatctttgccggcctcaacccgttgcaagtcgaggtcgtcaagaacaaggccggtctgccctccaagttgcaggagctcaaggccaaggacggatctgatgtcgataagctcatctcggaaggccggttgtatgttctggactactcggtcctcaaggatctcgacctcgaccgcaacggtgtcaccctgtacgcgccgacgatgctcatctaccgcactggtggtgacaagctcgacgtcctcggcatcatgcttgagccccgccgtgacgacgcgcccgtttacacgcccgactctgaaactcccaacaagttccttctcgccaagtgccacgttgcctgcgctgacaaccaagtgcaccagttcacgtaccatctcggttacgcccatcttgccacagagccacttgcgattgcaagccacaacgtcctggagaagaacagccatccgctcggcatgttcctcaagccacacttccgcgacaacatcggcatcaactacctcgcccgacagactcttgttgccgacgaagacgccatcacagaccacacctttgccacgggcaccgcgcagggcgtcagtatggtcgtcgacgccttcaagtcgtacaacttcctcgagtctggcttgcccgatgagctgcgccgtcgtggattcgaacggtcggacgacctcaaggtgtatcgctaccgcgacgatggctggttgatctgggacacgctctggaagtacgccgaggatatggtcaacgagctgtacggaacggacaacgatgtcgctgctgacaaggtcgtccaggagtgggcgaaggaagcatctggctcggacactgccgacgtccagggctttccggagtccatcacgaccaagtacatcctcacaaaggtcctgacgacgatcatctggcaagcgtccgccttgcactcggctctcaactacatccaatacccgtacactgcgacccccatcaaccgtgccgcctccatctttggaccggtccctgacggcgaagcggatatcaccgagcaggacatcctggatgtcatccctggtggtctggacgatgagaacaaccgtggtctgaccctctccatcttccaaggcctgctctcgtggctcctgcgcactcctgagaacccgacgctggacgaagtcggcagcccaatcccgaacaggaacaaccccatcgagtgggtcgagttccgctcgaagtacccccaggtctactacaacttggaccagaaccttgccgtggtggagaagatcatcgaggagcgcaacaagggccttgcttctccgtacgaggtgctccttcccagccacattgctgccagcatcaacatctga

SEQ ID NO: 5 - DNA, 2745 bp, Artificial Sequence
  Codon-optimized coding sequence of CoLOX-0317
atgaccagcagcccgaccgtgcgtagcatggttatgctggcggtgctggcggtttatgcgctggaaagcaccccgtgcgcgagcgcgtttgcgaccctgccgcgtgcgctggttcgtccgcaggcggcgctgaagtatcgtgcggaagataaaaacgatgtggatgtggcgccggcgggtagcaccgcgagcgacgttagcaagccggagggtaaagcgaccgcggttgcgaagggcaccgtgaacgcgccgatcgaggaagcgtggaaagtgttccgtagctttagcaacatgaaccaatggatgccggtttacggcgagtgggaagcgaccggtgatagcgtgggcgacacccgtaccttcaactttaaggatcagccgaccttctttaccaccgagcgtctggtgggtctggacgatagccaatataagatgaaatacaccctggttaactgcaaaggcagcccggtgccgatcgaaagcattgacaccatcgttaccttcaccgcgaacgacgatgtgaccgaggttgattggcgtagctggaccaagagcccgatggtggacctgattaaaggtcgtcaagcggcgggttatgcgggtggcattgcggcgctggatcgttatctgaacccgagcctgggcaccgtggacgttaccattaagagcgcggataacctggacggcaacttcctgagcagcagctacgcgaccctgatggttaccgatgcggatccggagcaggtgcatgcgaaggaatggggcaccagcccggagttcgatgcgaaaccggttcaatttagcctgctgaagccggacagcaaactgtatatgagcgtgatgctgaccaaatacggtgtggataccccggttggctatgcggtgttcgacatccagaagagcctgaaaagcggcgagaccgttaccgaaacctttcaactggaaggcagcaacgacgcgaccctgaccgttgagatggaactgaacctgcgtcagggtagcgtgctgccgcagagcaaggcgcagaagaacctggcgaccctggtggcgctgcagcaaagcgtggagcgtgttcgtgaccgtattgttaccatcggtaaactggcgggtgaaccggagaagagcgtgtgggagtacgagcgtaagagcggtctgccgaagagcgttaaaggtctgccgcgtagcgaagtgctgccgccgcacaaaattgcgctgatggttgacgcgatcgcggagtacgcgtatacccagttccaactggttcagcgtctgctgccggtgcgtaacagctacgatcgttatgcggcgtactttgcgccggaaggcgaggaatacgtgccgattccgcaaatcctgaaggacatgacctggagcaccgacgatgagttcattcgtcagatctttgcgggtctgaacccgctgcaagttgaagtggttaagaacaaagcgggtctgccgagcaagctgcaggagctgaaggcgaaagatggtagcgacgtggataaactgatcagcgagggccgtctgtatgttctggactacagcgtgctgaaggacctggatctggaccgtaacggtgttaccctgtatgcgccgaccatgctgatttaccgtaccggtggcgataaactggacgttctgggcatcatgctggaaccgcgtcgtgacgatgcgccggtgtacaccccggatagcgagaccccgaacaagttcctgctggcgaaatgccacgttgcgtgcgcggacaaccaggtgcaccaatttacctatcacctgggttatgcgcacctggcgaccgaaccgctggcgattgcgagccacaacgtgctggagaagaacagccacccgctgggcatgttcctgaaaccgcactttcgtgataacatcggcattaactacctggcgcgtcagaccctggttgcggatgaagacgcgatcaccgatcatacctttgcgaccggcaccgcgcaaggcgtgagcatggtggttgatgcgttcaagagctataactttctggaaagcggtctgccggatgagctgcgtcgtcgtggtttcgagcgtagcgacgatctgaaggtttaccgttatcgtgacgatggttggctgatttgggataccctgtggaaatacgcggaggacatggttaacgaactgtatggcaccgataacgacgtggcggcggacaaggtggttcaggagtgggcgaaagaagcgagcggtagcgataccgcggacgttcaaggcttcccggaaagcattaccaccaagtacatcctgaccaaagtgctgaccaccatcatttggcaagcgagcgcgctgcacagcgcgctgaactatatccaatacccgtataccgcgaccccgattaaccgtgcggcgagcatctttggtccggttccggatggcgaggcggacattaccgaacaggatattctggacgtgatcccgggtggcctggacgatgagaacaaccgtggtctgaccctgagcatcttccaaggtctgctgagctggctgctgcgtaccccggaaaacccgaccctggatgaggttggtagcccgattccgaaccgtaacaacccgatcgagtgggttgaatttcgtagcaaatacccgcaggtgtactataacctggaccaaaacctggcggtggttgaaaagatcattgaggaacgtaacaaaggcctggcgagcccgtatgaggtgctgctgccgagccacattgcggcgagcatcaacatttaa

SEQ ID NO: 6 - protein, 914 aa, Cladophora oligoclada
MTSSPTVRSMVMLAVLAVYALESTPCASAFATLPRALVRPQAALKYRAEDKNDVDVAPAGSTASDVSKPEGKATAVAKGTVNAPIEEAWKVFRSFSNMNQWMPVYGEWEATGDSVGDTRTFNFKDQPTFFTTERLVGLDDSQYKMKYTLVNCKGSPVPIESIDTIVTFTANDDVTEVDWRSWTKSPMVDLIKGRQAAGYAGGIAALDRYLNPSLGTVDVTIKSADNLDGNFLSSSYATLMVTDADPEQVHAKEWGTSPEFDAKPVQFSLLKPDSKLYMSVMLTKYGVDTPVGYAVFDIQKSLKSGETVTETFQLEGSNDATLTVEMELNLRQGSVLPQSKAQKNLATLVALQQSVERVRDRIVTIGKLAGEPEKSVWEYERKSGLPKSVKGLPRSEVLPPHKIALMVDAIAEYAYTQFQLVQRLLPVRNSYDRYAAYFAPEGEEYVPIPQILKDMTWSTDDEFIRQIFAGLNPLQVEVVKNKAGLPSKLQELKAKDGSDVDKLISEGRLYVLDYSVLKDLDLDRNGVTLYAPTMLIYRTGGDKLDVLGIMLEPRRDDAPVYTPDSETPNKFLLAKCHVACADNQVHQFTYHLGYAHLATEPLAIASHNVLEKNSHPLGMFLKPHFRDNIGINYLARQTLVADEDAITDHTFATGTAQGVSMVVDAFKSYNFLESGLPDELRRRGFERSDDLKVYRYRDDGWLIWDTLWKYAEDMVNELYGTDNDVAADKVVQEWAKEASGSDTADVQGFPESITTKYILTKVLTTIIWQASALHSALNYIQYPYTATPINRAASIFGPVPDGEADITEQDILDVIPGGLDDENNRGLTLSIFQGLLSWLLRTPENPTLDEVGSPIPNRNNPIEWVEFRSKYPQVYYNLDQNLAVVEKIIEERNKGLASPYEVLLPSHIAASINI

SEQ ID NO: 7 - DNA, 2745 bp, Cladophora oligoclada
atgacgtcgtctccgaccgtcagatcgatggtaatgctggccgtgctggccgtctctgccctggagagcgcgccctgcgcctcggcctttgccacgctcccccgcgccctcgtacgaccgcaagccgccctcaagtaccgagccgaggacaaaaacgacgtcgatgtcgccccggctggtagcactgcctccgacgtgagcaagcccgaaggaaaggccactgctgtcgccaagggtactgtcaacgcgcccatcgaggaggcatggaaggtcttccggtctttttccaacatggaccaatggatgcccgtgtacggcgagtgggaggccacgggagactcagtcggagacacccgcacgttcaacttcaaggatcagccgaccttcttcactaccgagaggcttgtcggcctggacgactcccagtacaagatgaagtacaccctcgtcgactgcaagggctcgcccgtgcccatcgaatctattgacaccatcgtcaccttcactgcaaacgatgatgtgaccgaggttgactggcgctcctggacgaagtcgcccatggtcgacttgatcaagggacgtcaggcggccgggtatgctggcggcatcgcagcgctcgaccggtacctgaacccgtcccttggcaccgtcgatgtcaccatcaagtcggccgacaacctcgatggcgatttcctgtccagctcctacgccactctcatggtcacggacgccgaccccgagcaagtgcatgccaaggagtgggggacgagtcctgagttcgatgccaagcccgtccagttcagcctgctcaagcccgactccaagctctacatgaacgtcatgctgaccaagtacggcgtcgacacgcccgtcggatacgccgtctttgacatccagaagagcctcaagtccggcgagactgtgaccgagacctttcagctcgagggcagcaacgatgcaacgttgacggtcgagatggagctcaacctccggcagggcagcgtcctccctcaatccaaggcccagaagaatctggcgacccttgtcgccctccagcagtctgtcgagagggtccgagaccgcatcgttactatcggcaagctggccggcgagcccgagaagtcggtatgggagtacgagcgaaagtccggccttcccaagtccgtcaagggtcttcctcgatcggaagtgctgccgccgcacaagatcgctctcatggtcgacgccatcgccgagtacgcttacactcagttccagctcgtccagcgcctgctccccgtcagaaactcgtacgaccggtacgccgcttactttgccccagaaggcgaggagtacgttcccatcccgcagatcctcaaggacatgacgtggtccaccgacgacgagttcatccgccagatctttgccggcctcaacccgttgcaagtcgaggtcgtcaagaacaaggccggtctgccctccaagttgcaggagctcaaggccaaggacggatctgatgtcgataagctcatctcggaaggccggttgtatgttctggactactcggtcctcaaggatctcgacctcaaccgcaacggtgtcaccctgtacgcgccgacgatgctcatctaccgcactggtggtgacaagctcgacgtcctcggcatcatgctcgagccccgccgtgacgatgcgcccgtttacacgcccgactctgaaactcccaacaagttccttctcgccaagtgccacgttgcctgcgctgacaaccaagtgcaccagttcacgtaccatctcggttacgcccatcttgccacggagccacttgcgatcgcaagccacaacgtcctggagaagaacagccatccgctcggcatgttcctcaagccacacttgcgcgacaacattggcatcaactacctcgcccggcagactcttgttgccgacgaagacgccatcacagaccacacctttgccacgggcaccgcgcagggcgtcagtatggtcgtcgacgccttcaagtcgtacaacttcctcgagtctggcttgcccgatgagctgcgccgtcgtggattcgaacggtcggacgacctcaaggtgtatcgctaccgcgacgatggctggttggtctgggacacgctctggaagtacgccgaggatatggtcaacgagctgtacggaacggacaacgatgtcgctgctgacaaggtcgtccaggagtgggcgagggaagcatctggctcggacactgccgacgtccagggctttccggagtccatcacgaccaagtacatcctcacaaaggtcctgacgacgatcatctggcaagcgtccgccttgcactcggctctcaactacatccaatacccgtacactgcgacccccatcaaccgtgccgcctccatctttggaccggtccctgacggcgaagcggatatcaccgagcaggacatcctggatgtcatccctggtggtctggacgatgagaacaaccgtggtctgaccctctccatcttccaaggcctgctctcgtggctcctgcgcactcctgagaacccgacgctggacgaagtcggcagcccaatcccgaacaggaacaaccccatcgagtgggtcgagttccgctcgaagtacccccaggtctactacaacttggaccagaaccttgccgtggtggagaagatcatcgaggagcgcaacaagggccttgcttctccgtacgaggtgctccttcccagccacattgctgccagcatcaacatctga

SEQ ID NO: 8 - DNA, 2745 bp, Artificial Sequence
  Codon-optimized coding sequence of CoLOX-19
atgaccagcagcccgaccgtgcgtagcatggttatgctggcggttctggcggttagcgcgctggaaagcgcgccgtgcgcgagcgcgtttgcgaccctgccgcgtgcgctggttcgtccgcaggcggcgctgaagtaccgtgcggaagacaaaaacgatgttgatgttgcgccggcgggtagcaccgcgagcgatgttagcaagccggagggtaaagcgaccgcggttgcgaagggcaccgtgaacgcgccgatcgaggaagcgtggaaagtgttccgtagctttagcaacatggaccaatggatgccggtttatggcgagtgggaagcgaccggtgacagcgtgggcgatacccgtaccttcaactttaaggatcagccgaccttctttaccaccgagcgtctggtgggtctggacgatagccaatataagatgaaatacaccctggttgactgcaaaggcagcccggtgccgatcgaaagcattgataccatcgttaccttcaccgcgaacgacgatgtgaccgaggttgactggcgtagctggaccaagagcccgatggtggatctgattaaaggtcgtcaagcggcgggttatgcgggtggcattgcggcgctggaccgttatctgaacccgagcctgggcaccgtggacgttaccattaagagcgcggataacctggacggcgattttctgagcagcagctacgcgaccctgatggttaccgatgcggatccggagcaggtgcatgcgaaggaatggggcaccagcccggagttcgacgcgaaaccggttcaatttagcctgctgaagccggatagcaaactgtatatgaacgtgatgctgaccaaatacggtgtggacaccccggttggctatgcggtgttcgatatccagaagagcctgaaaagcggcgagaccgttaccgaaacctttcaactggaaggcagcaacgacgcgaccctgaccgttgagatggaactgaacctgcgtcagggtagcgtgctgccgcagagcaaggcgcagaagaacctggcgaccctggtggcgctgcagcaaagcgtggagcgtgttcgtgaccgtattgttaccatcggtaaactggcgggtgaaccggagaagagcgtgtgggagtacgagcgtaagagcggtctgccgaagagcgttaaaggtctgccgcgtagcgaagtgctgccgccgcacaaaattgcgctgatggttgacgcgatcgcggagtacgcgtatacccagttccaactggttcagcgtctgctgccggtgcgtaacagctacgaccgttatgcggcgtactttgcgccggaaggcgaggaatacgtgccgattccgcaaatcctgaaggatatgacctggagcaccgacgatgagttcattcgtcagatctttgcgggtctgaacccgctgcaagttgaagtggttaagaacaaagcgggtctgccgagcaagctgcaggagctgaaggcgaaagacggtagcgacgtggataaactgatcagcgagggccgtctgtatgttctggattacagcgtgctgaaggacctggatctgaaccgtaacggtgttaccctgtatgcgccgaccatgctgatttaccgtaccggtggcgacaaactggatgttctgggcatcatgctggaaccgcgtcgtgacgatgcgccggtgtacaccccggacagcgagaccccgaacaagttcctgctggcgaaatgccacgttgcgtgcgcggataaccaggtgcaccaatttacctatcacctgggttatgcgcacctggcgaccgaaccgctggcgattgcgagccacaacgtgctggagaagaacagccacccgctgggcatgttcctgaaaccgcacctgcgtgacaacatcggcattaactacctggcgcgtcagaccctggttgcggacgaagatgcgatcaccgatcacacctttgcgaccggcaccgcgcaaggcgtgagcatggtggttgacgcgttcaagagctataactttctggaaagcggtctgccggatgagctgcgtcgtcgtggtttcgagcgtagcgacgatctgaaggtttaccgttatcgtgacgatggttggctggtgtgggacaccctgtggaaatacgcggaggatatggttaacgaactgtatggcaccgacaacgatgtggcggcggacaaagtggttcaggagtgggcgcgtgaagcgagcggtagcgacaccgcggatgttcaaggcttcccggaaagcattaccaccaagtacatcctgaccaaagtgctgaccaccatcatttggcaagcgagcgcgctgcacagcgcgctgaactatattcaatacccgtataccgcgaccccgattaaccgtgcggcgagcatctttggtccggttccggacggcgaggcggatattaccgaacaggacattctggatgtgatcccgggtggcctggacgatgagaacaaccgtggtctgaccctgagcatcttccaaggtctgctgagctggctgctgcgtaccccggaaaacccgaccctggacgaggttggtagcccgattccgaaccgtaacaacccgatcgagtgggttgaatttcgtagcaaatacccgcaggtgtactataacctggatcaaaacctggcggtggttgaaaagatcattgaggaacgtaacaaaggcctggcgagcccgtatgaggtgctgctgccgagccacattgcggcgagcatcaacatttaa

SEQ ID NO: 9 - protein, 914 aa, Cladophora oligoclada
MTSSPTVRSMVMLAVLAVSALESAPCASAFATLPRALVRPQAALKYRAEDKNDVDVAPAGSTASDVSKPEGKATAVAKGTVNAPIEEAWKVFRSFSNMDQWMPVYGEWEATGDSVGDTRTFNFKDQPTFFTTERLVGLDDSQYKMKYTLVDCKGSPVPIESIDTIVTFTANDDVTEVDWRSWTKSPMVDLIKGRQAAGYAGGIAALDRYLNPSLGTVDVTIKSADNLDGDFLSSSYATLMVTDADPEQVHAKEWGTSPEFDAKPVQFSLLKPDSKLYMNVMLTKYGVDTPVGYAVFDIQKSLKSGETVTETFQLEGSNDATLTVEMELNLRQGSVLPQSKAQKNLATLVALQQSVERVRDRIVTIGKLAGEPEKSVWEYERKSGLPKSVKGLPRSEVLPPHKIALMVDAIAEYAYTQFQLVQRLLPVRNSYDRYAAYFAPEGEEYVPIPQILKDMTWSTDDEFIRQIFAGLNPLQVEVVKNKAGLPSKLQELKAKDGSDVDKLISEGRLYVLDYSVLKDLDLNRNGVTLYAPTMLIYRTGGDKLDVLGIMLEPRRDDAPVYTPDSETPNKFLLAKCHVACADNQVHQFTYHLGYAHLATEPLAIASHNVLEKNSHPLGMFLKPHLRDNIGINYLARQTLVADEDAITDHTFATGTAQGVSMVVDAFKSYNFLESGLPDELRRRGFERSDDLKVYRYRDDGWLVWDTLWKYAEDMVNELYGTDNDVAADKVVQEWAREASGSDTADVQGFPESITTKYILTKVLTTIIWQASALHSALNYIQYPYTATPINRAASIFGPVPDGEADITEQDILDVIPGGLDDENNRGLTLSIFQGLLSWLLRTPENPTLDEVGSPIPNRNNPIEWVEFRSKYPQVYYNLDQNLAVVEKIIEERNKGLASPYEVLLPSHIAASINI

SEQ ID NO: 10 - DNA, 2745 bp, Cladophora oligoclada
atgacgtcgtctccgaccgtcagatcgatggtaatgctggccgtgctggccgtctctgccctggagagcgcgccctgcgcctcggcctttgccacgctcccccgcgccctcgtacgaccgcaagccgccctcaagtaccgagccgaggacaaaaacgacgtcgatgtcgccccggctggtagcactgcctccgacgtgagcaagcccgaaggcaaggccaccgccgtcgccaagggtactgtcaacgcgcccatcgaggaggcatggaaggtcttccggtctttttccaacatgaaccaatggatgcccgtgtacggcgagtgggaggccacgggagactcagtcggagacacccgcacgttcaacttcaaggatcagccgaccttcttcactaccgagaggcttgtcggcctggacgactcccagtacaagatgaagtacaccctcgtcgactgcaagggctcgcccgtgcccatcgaatctatcgacaccatcgtcaccttcactgcaaacgatgatgtgaccgaggttgactggcgctcctggacgaagtcgcccatggtcgacttgatcaagggacgtcaggcggccgggtatgccggcggcatcgcagcgctcgaccggtacctgaacccgtcccttggcaccgtcgatgtcaccatcaagtcggccgacaacctcgatggtgatttcctgtccagctcctacgccactctcatggtcacggacgccgaccccgagcaagtgcatgccaaggagtgggggacgagtcctgagtttgatgccaagcccgtccagttcagcctgctcaagcccgactccaagctctacatgagcgtcatgctgaccaagtgcggcgtcgacgcccccgtcggatacgccgtctttgacatccagaagagcctcaagtccggcgagactgtgaccgagacctttcagctcgagggcagcaacgatgcaacgttgacggtcgagatggagctcaacctccggcagggcagcatcctccctcaatccaaggcccagaagaatctggcgacccttgtcgccctccagcagtctgtcgagagggtccgagaccgcatcgttactatcggcaagctggccggcgagcccgagaagtcggtatgggagtacgagcgaaagtccggccttcccaagtccgtcaagggccttcctcggtcggaagtgctgccgccgcacaagatcgccctcatggtcgacgccatcgccgagtacgcttacacccagttccagctcgtccagcgcctgctccccgtcagaaactcgtacgaccggtacgccgcttactttgccccagaaggcgaggagtacgttcccatcccgcagatcctcaaggacatgacgtggtccaccgacgacgagttcatccgccagatctttgccggcctcaacccgttgcaagtcgaggtcgtcaagaacaaggccggtctgccctccaagttgcaggagctcaaggccaaggacggatctgatgtcgataagctcatctcggaaggccggttgtatgttctggactactcggtcctcaaggatctcgacctcaaccgcaacggtgtcaccctgtacgcgccgacgatgctcatctaccgcactggtggtgacaagctcgacgtcctcggcatcatgctcgagccccgccgtgacgatgcgcccgtttacacgcccgactctgaaactcccaacaagttccttctcgccaagtgccacgttgcctgcgctgacaaccaagtgcaccagttcacgtaccatctcggttacgcccatcttgccacggagccacttgcgatcgcaagccacaacgtcctggagaagaacagccatccgctcggcatgttcctcaagccacacttgcgcgacaacattggcatcaactacctcgcccggcagactcttgttgccgacgaagacgccatcacagaccacacctttgccacgggcaccgcgcagggcgtcagtatggtcgtcgacgccttcaagtcgtacaacttcctcgagtctggcttgcccgatgagctgcgccgtcgtggattcgaacggtcggacgacctcaaggtgtatcgctaccgcgacgatggctggttggtctgggacacgctctggaagtacgccgaggatatggtcaacgagctgtacggaacggacaacgatgtcgctgctgacaaggtcgtccaggagtgggcgagggaagcatctggctcggacactgccgacgtccagggctttccggagtccatcacgaccaagtacatcctcacaaaggtcctgacgacgatcatctggcaagcgtccgccttgcactcggctctcaactacatccaatacccgtacactgcgacccccatcaaccgtgccgcctccatctttggaccggtccctgacggcgaagcggatatcaccgagcaggacatcctggatgtcatccctggtggtctgggtgatgagaacaaccgtggtctgaccctctccatcttccaaggcctgctctcgtggctcctgcgcactcctgagaacccgacgctggacgaagtcggcagtccaatcccgaacaggaacaaccccatcgagtgggtcgagttccgctcgaagtatccccaggtctactacaacttggaccagaaccttgccgtggtggagaagatcatcgaggagcgcaacaagggccttgcttctccgtacgaggtgctccttcccagccacatcgctgccagcatcaacatctga

SEQ ID NO: 11 - DNA, 2745 bp, Artificial Sequence
  Codon-optimized coding sequence of CoLOX-22
atgaccagcagcccgaccgtgcgtagcatggttatgctggcggttctggcggttagcgcgctggaaagcgcgccgtgcgcgagcgcgtttgcgaccctgccgcgtgcgctggttcgtccgcaggcggcgctgaagtatcgtgcggaagacaaaaacgatgttgatgttgcgccggcgggtagcaccgcgagcgatgttagcaagccggagggtaaagcgaccgcggttgcgaagggcaccgtgaacgcgccgatcgaggaagcgtggaaagtgttccgtagctttagcaacatgaaccaatggatgccggtttacggcgagtgggaagcgaccggtgacagcgtgggcgatacccgtaccttcaactttaaggaccagccgaccttctttaccaccgagcgtctggtgggtctggacgatagccaatataagatgaaatacaccctggttgactgcaaaggcagcccggtgccgatcgaaagcattgataccatcgttaccttcaccgcgaacgacgatgtgaccgaggttgactggcgtagctggaccaagagcccgatggtggatctgattaaaggtcgtcaagcggcgggttatgcgggtggcattgcggcgctggaccgttacctgaacccgagcctgggcaccgtggacgttaccatcaagagcgcggataacctggacggcgattttctgagcagcagctacgcgaccctgatggttaccgatgcggatccggagcaggtgcatgcgaaggaatggggcaccagcccggagttcgacgcgaaaccggttcaatttagcctgctgaagccggatagcaaactgtatatgagcgtgatgctgaccaaatgcggtgtggatgcgccggttggttatgcggtgttcgatattcagaagagcctgaaaagcggcgagaccgttaccgaaacctttcaactggaaggcagcaacgacgcgaccctgaccgtggagatggaactgaacctgcgtcagggtagcatcctgccgcagagcaaggcgcagaagaacctggcgaccctggttgcgctgcagcaaagcgtggagcgtgttcgtgatcgtattgttaccatcggtaaactggcgggtgaaccggagaagagcgtgtgggagtatgagcgtaagagcggtctgccgaagagcgttaaaggtctgccgcgtagcgaagtgctgccgccgcacaaaattgcgctgatggttgacgcgatcgcggagtacgcgtatacccagttccaactggttcagcgtctgctgccggtgcgtaacagctacgaccgttatgcggcgtactttgcgccggaaggcgaggaatacgtgccgattccgcaaatcctgaaggatatgacctggagcaccgacgatgagttcattcgtcagatctttgcgggtctgaacccgctgcaagttgaagtggttaagaacaaagcgggtctgccgagcaagctgcaggagctgaaggcgaaagacggtagcgacgtggataaactgatcagcgagggccgtctgtatgttctggattacagcgtgctgaaggacctggatctgaaccgtaacggtgttaccctgtatgcgccgaccatgctgatttaccgtaccggtggcgacaaactggatgttctgggcatcatgctggaaccgcgtcgtgacgatgcgccggtgtacaccccggacagcgagaccccgaacaagttcctgctggcgaaatgccacgttgcgtgcgcggataaccaggtgcaccaatttacctatcacctgggttatgcgcacctggcgaccgaaccgctggcgattgcgagccacaacgtgctggagaagaacagccacccgctgggcatgttcctgaaaccgcacctgcgtgacaacatcggcattaactatctggcgcgtcagaccctggttgcggacgaagatgcgatcaccgatcacacctttgcgaccggcaccgcgcaaggcgtgagcatggtggttgacgcgttcaagagctacaactttctggaaagcggtctgccggatgagctgcgtcgtcgtggtttcgagcgtagcgacgatctgaaggtttaccgttatcgtgacgatggttggctggtgtgggacaccctgtggaaatatgcggaggatatggttaacgaactgtacggcaccgacaacgatgtggcggcggacaaagtggttcaggagtgggcgcgtgaagcgagcggtagcgacaccgcggatgttcaaggcttcccggaaagcattaccaccaagtatatcctgaccaaagtgctgaccaccatcatttggcaagcgagcgcgctgcacagcgcgctgaactacattcaatacccgtataccgcgaccccgattaaccgtgcggcgagcatctttggtccggttccggacggcgaggcggatattaccgaacaggacattctggatgtgatcccgggtggcctgggtgacgagaacaaccgtggcctgaccctgagcatcttccaaggtctgctgagctggctgctgcgtaccccggaaaacccgaccctggatgaggttggcagcccgattccgaaccgtaacaacccgatcgagtgggttgaatttcgtagcaaatatccgcaggtgtactataacctggaccaaaacctggcggtggttgaaaagatcattgaggaacgtaacaaaggtctggcgagcccgtacgaggtgctgctgccgagccacattgcggcgagcatcaacatttaa

SEQ ID NO: 12 - protein, 914 aa, Cladophora oligoclada
MTSSPTVRSMVMLAVLAVSALESAPCASAFATLPRALVRPQAALKYRAEDKNDVDVAPAGSTASDVSKPEGKATAVAKGTVNAPIEEAWKVFRSFSNMNQWMPVYGEWEATGDSVGDTRTFNFKDQPTFFTTERLVGLDDSQYKMKYTLVDCKGSPVPIESIDTIVTFTANDDVTEVDWRSWTKSPMVDLIKGRQAAGYAGGIAALDRYLNPSLGTVDVTIKSADNLDGDFLSSSYATLMVTDADPEQVHAKEWGTSPEFDAKPVQFSLLKPDSKLYMSVMLTKCGVDAPVGYAVFDIQKSLKSGETVTETFQLEGSNDATLTVEMELNLRQGSILPQSKAQKNLATLVALQQSVERVRDRIVTIGKLAGEPEKSVWEYERKSGLPKSVKGLPRSEVLPPHKIALMVDAIAEYAYTQFQLVQRLLPVRNSYDRYAAYFAPEGEEYVPIPQILKDMTWSTDDEFIRQIFAGLNPLQVEVVKNKAGLPSKLQELKAKDGSDVDKLISEGRLYVLDYSVLKDLDLNRNGVTLYAPTMLIYRTGGDKLDVLGIMLEPRRDDAPVYTPDSETPNKFLLAKCHVACADNQVHQFTYHLGYAHLATEPLAIASHNVLEKNSHPLGMFLKPHLRDNIGINYLARQTLVADEDAITDHTFATGTAQGVSMVVDAFKSYNFLESGLPDELRRRGFERSDDLKVYRYRDDGWLVWDTLWKYAEDMVNELYGTDNDVAADKVVQEWAREASGSDTADVQGFPESITTKYILTKVLTTIIWQASALHSALNYIQYPYTATPINRAASIFGPVPDGEADITEQDILDVIPGGLGDENNRGLTLSIFQGLLSWLLRTPENPTLDEVGSPIPNRNNPIEWVEFRSKYPQVYYNLDQNLAVVEKIIEERNKGLASPYEVLLPSHIAASINI

SEQ ID NO: 13 - DNA, 2745 bp, Cladophora oligoclada
atgacgtcgtctccgaccgtcagatcgatggtaatgctggccgtgctggccgtctctgccctggagagcgcgccctgcgcctcggcctttgccacgctcccccgcgccctcgtacgaccgcaagccgccctcaagtaccgagccgaggacaaaaacgacgtcgatgtcgccccggctggtagcactgcctccgacgtgagcaagcccgaaggaaaggccactgctgtcgccaagggtactgtcaacgcgcccatcgaggaggcatggaaggtcttccggtctttttccaacatggaccaatggatgcccgtgtacggcgagtgggaggccacgggagactcagtcggagacacccgcacgttcaacttcaaggatcagccgaccttcttcactaccgagaggcttgtcggcctggacgactcccagtacaagatgaagtacaccctcgtcgactgcaagggctcgcccgtgcccatcgaatctattgacaccatcgtcaccttcactgcaaacgatgatgtgaccgaggttgactggcgctcctggacgaagtcgcccatggtcgacttgatcaagggacgtcaggcggccgggtatgctggcggcatcgcagcgctcgaccggtacctgaacccgtcccttggcaccgtcgatgtcaccatcaagtcggccgacaacctcgatggcgatttcctgtccagctcctacgccactctcatggtcacggacgccgaccccgagcaagtgcatgccaaggagtgggggacgagtcctgagttcgatgccaagcccgtccagttcagcctgctcaagcccgactccaagctctacatgaacgtcatgctgaccaagtacggcgtcgacacgcccgtcggatacgccgtctttgacatccagaagagcctcaagtccggcgagactgtgaccgagacctttcagctcgagggcagcaacgatgcaacgttgacggtcgagatggagctcaacctccggcagggcagcgtcctccctcaatccaaggcccagaagaatctggcgacccttgtcgccctccagcagtctgtcgagagggtccgagaccgcatcgttactatcggcaagctggccggcgagcccgagaagtcggtatgggagtacgagcgaaagtccggccttcccaagtccgtcaagggtcttcctcgatcggaagtgctgccgccgcacaagatcgctctcatggtcgacgccatcgccgagtacgcttacactcagttccagctcgtccagcgcctgctccccgtcagaaactcgtacgaccggtacgccgcttactttgccccagaaggcgaggagtacgttcccatcccgcagatcctcaaggacatgacgtggtccaccgacgacgagttcatccgccagatctttgccggcctcaacccgttgcaagtcgaggtcgtcaagaacaaggccggtctgccctccaagttgcaggagctcaaggccaaggacggatctgatgtcgataagctcatctcggaaggccggttgtatgttctggactactcggtcctcaaggatctcgacctcaaccgcaacggtgtcaccctgtacgcgccgacgatgctcatctaccgcactggtggtgacaagctcgacgtcctcggcatcatgctcgagccccgccgtgacgatgcgcccgtttacacgcccgactctgaaactcccaacaagttccttcttgccaagtgccacgttgcctgcgctgacaaccaagtgcaccagttcacgtaccatctcggttacgcccatcttgccacggagccacttgcgatcgcaagccacaacgtcctggagaagaacagccatccgctcggcatgttcctcaagccacacttccgcgacaacatcggcatcaactacctcgcccggcagactcttgttgccgacgaagacgccatcacagaccacacttttgccacgggcaccgcgcagggcgtcagtatggtcgtcgacgccttcaagtcgtacaacttcctcgagtctggcttgcccgatgagctgcgccgtcgtggattcgaacggtcggacgacctcaaggtgtatcgctaccgcgacgatggctggttggtttgggacacgctctggaagtacgccgaggatatggtcaacgagctgtacggaacggacaacgatgtcactgctgacaaggtcgtccaggagtgggcgagggaagcatctggctcggacactgccgacgtccagggctttccggagtccatcacgaccaagtacatcctcacaaaggtcctgacgacgatcatctggcaagcgtccgccttgcactcggctctcaactacatccaatacccgtacactgcgacccccatcaaccgtgccgcctccatctttggaccggtccctgacggcgaagcggatatcaccgagcaggacatcctggatgtcatccctggtggtctggacgatgagaacaaccgtggtctgaccctctccatcttccaaggcctgctctcgtggctcctgcgcactcctgagaacccgacgctggacgaagtcggcagcccaatcccgaacaggaacaaccccatcgagtgggtcgagttccgctcgaagtacccccaggtctactacaacttggaccagaaccttgccgtggtggagaagatcatcgaggagcgcaacaagggccttgcttctccgtacgaggtgctccttcccagccacattgctgccagcatcaacatctga

SEQ ID NO: 14 - DNA, 2745 bp, Artificial Sequence
  Codon-optimized coding sequence of CoLOX-d4
atgaccagcagcccgaccgtgcgtagcatggttatgctggcggttctggcggttagcgcgctggaaagcgcgccgtgcgcgagcgcgtttgcgaccctgccgcgtgcgctggttcgtccgcaggcggcgctgaagtaccgtgcggaagacaaaaacgatgttgatgttgcgccggcgggtagcaccgcgagcgatgttagcaagccggagggtaaagcgaccgcggttgcgaagggcaccgtgaacgcgccgatcgaggaagcgtggaaagtgttccgtagctttagcaacatggaccaatggatgccggtttatggcgagtgggaagcgaccggtgacagcgtgggcgatacccgtaccttcaactttaaggatcagccgaccttctttaccaccgagcgtctggtgggtctggacgatagccaatataagatgaaatacaccctggttgactgcaaaggcagcccggtgccgatcgaaagcattgataccatcgttaccttcaccgcgaacgacgatgtgaccgaggttgactggcgtagctggaccaagagcccgatggtggatctgattaaaggtcgtcaagcggcgggttatgcgggtggcattgcggcgctggaccgttatctgaacccgagcctgggcaccgtggacgttaccattaagagcgcggataacctggacggcgatttcctgagcagcagctacgcgaccctgatggttaccgatgcggatccggagcaggtgcatgcgaaggaatggggcaccagcccggagttcgacgcgaaaccggttcaatttagcctgctgaagccggatagcaaactgtatatgaacgtgatgctgaccaaatacggtgtggacaccccggttggctatgcggtgttcgatatccagaagagcctgaaaagcggcgagaccgttaccgaaacctttcaactggaaggcagcaacgacgcgaccctgaccgttgagatggaactgaacctgcgtcagggtagcgtgctgccgcagagcaaggcgcagaagaacctggcgaccctggtggcgctgcagcaaagcgtggagcgtgttcgtgaccgtattgttaccatcggtaaactggcgggtgaaccggagaagagcgtgtgggagtacgagcgtaagagcggtctgccgaagagcgttaaaggtctgccgcgtagcgaagtgctgccgccgcacaaaattgcgctgatggttgacgcgatcgcggagtacgcgtatacccagttccaactggttcagcgtctgctgccggtgcgtaacagctacgaccgttatgcggcgtactttgcgccggaaggcgaggaatacgtgccgattccgcaaatcctgaaggatatgacctggagcaccgacgatgagttcattcgtcagatctttgcgggtctgaacccgctgcaagttgaagtggttaagaacaaagcgggtctgccgagcaagctgcaggagctgaaggcgaaagacggtagcgacgtggataaactgatcagcgagggccgtctgtatgttctggattacagcgtgctgaaggacctggatctgaaccgtaacggtgttaccctgtatgcgccgaccatgctgatttaccgtaccggtggcgacaaactggatgttctgggcatcatgctggaaccgcgtcgtgacgatgcgccggtgtacaccccggacagcgagaccccgaacaagttcctgctggcgaaatgccacgttgcgtgcgcggataaccaggtgcaccaatttacctatcacctgggttatgcgcacctggcgaccgaaccgctggcgattgcgagccacaacgtgctggagaagaacagccacccgctgggcatgttcctgaaaccgcactttcgtgacaacatcggcattaactacctggcgcgtcagaccctggttgcggacgaagatgcgatcaccgatcatacctttgcgaccggcaccgcgcaaggcgtgagcatggtggttgacgcgttcaagagctataactttctggaaagcggtctgccggatgagctgcgtcgtcgtggtttcgagcgtagcgacgatctgaaggtttaccgttatcgtgacgatggttggctggtgtgggacaccctgtggaaatacgcggaggatatggttaacgaactgtatggcaccgacaacgatgtgaccgcggacaaagtggttcaggagtgggcgcgtgaagcgagcggtagcgacaccgcggatgttcaaggcttcccggaaagcattaccaccaagtacatcctgaccaaagtgctgaccaccatcatttggcaagcgagcgcgctgcacagcgcgctgaactatattcaatacccgtataccgcgaccccgattaaccgtgcggcgagcatctttggtccggttccggacggcgaggcggatattaccgaacaggacattctggatgtgatcccgggtggcctggacgatgagaacaaccgtggtctgaccctgagcatcttccaaggtctgctgagctggctgctgcgtaccccggaaaacccgaccctggacgaggttggtagcccgattccgaaccgtaacaacccgatcgagtgggttgaatttcgtagcaaatacccgcaggtgtactataacctggatcaaaacctggcggtggttgaaaagatcattgaggaacgtaacaaaggcctggcgagcccgtatgaggtgctgctgccgagccacattgcggcgagcatcaacatttaa

SEQ ID NO: 15 - protein, 914 aa, Cladophora oligoclada
MTSSPTVRSMVMLAVLAVSALESAPCASAFATLPRALVRPQAALKYRAEDKNDVDVAPAGSTASDVSKPEGKATAVAKGTVNAPIEEAWKVFRSFSNMDQWMPVYGEWEATGDSVGDTRTFNFKDQPTFFTTERLVGLDDSQYKMKYTLVDCKGSPVPIESIDTIVTFTANDDVTEVDWRSWTKSPMVDLIKGRQAAGYAGGIAALDRYLNPSLGTVDVTIKSADNLDGDFLSSSYATLMVTDADPEQVHAKEWGTSPEFDAKPVQFSLLKPDSKLYMNVMLTKYGVDTPVGYAVFDIQKSLKSGETVTETFQLEGSNDATLTVEMELNLRQGSVLPQSKAQKNLATLVALQQSVERVRDRIVTIGKLAGEPEKSVWEYERKSGLPKSVKGLPRSEVLPPHKIALMVDAIAEYAYTQFQLVQRLLPVRNSYDRYAAYFAPEGEEYVPIPQILKDMTWSTDDEFIRQIFAGLNPLQVEVVKNKAGLPSKLQELKAKDGSDVDKLISEGRLYVLDYSVLKDLDLNRNGVTLYAPTMLIYRTGGDKLDVLGIMLEPRRDDAPVYTPDSETPNKFLLAKCHVACADNQVHQFTYHLGYAHLATEPLAIASHNVLEKNSHPLGMFLKPHFRDNIGINYLARQTLVADEDAITDHTFATGTAQGVSMVVDAFKSYNFLESGLPDELRRRGFERSDDLKVYRYRDDGWLVWDTLWKYAEDMVNELYGTDNDVTADKVVQEWAREASGSDTADVQGFPESITTKYILTKVLTTIIWQASALHSALNYIQYPYTATPINRAASIFGPVPDGEADITEQDILDVIPGGLDDENNRGLTLSIFQGLLSWLLRTPENPTLDEVGSPIPNRNNPIEWVEFRSKYPQVYYNLDQNLAVVEKIIEERNKGLASPYEVLLPSHIAASINI

SEQ ID NO: 16 - DNA, 1749 bp, Ulva fasciata
atgccttccatcaaaccatgcctaccgggtgactctgccaacagcgcagcccggacagcctcaatcaaggagaagcgggcgcagattggatacgactacaagatgctccctaagctcgccctggcctcagcacccccagcaaagttcgtggagctctctgatgcctacatggctgagcgcattggtgaaactgcaaagttttttaagaacaaggagatgacgaaggcccggaggatgtttgacgttgtcaacaggatggaggacttcaacgactatttcattctccctcctgtgatcgcgccggagcatgctaagggcaagtggatggaggatgacttttttgcggagcagcgcctgtccggggcaaaccctctggtcctggctaagctcgaccgtgacgacgcccgcgcagaaatcctcgaggatatgaaccttgacttcagcgtcaacagcgagctcagcagaggcaacatctacgtctgcgactacactgggacggacccgacgtaccgcggcccttgcatggtcacgggaggcgaaaacaactctggaaagaagaagtggctgccaaaacccctatcatggttccgctggattgaggacgacaaaaacaaggtgggcggcaagctcgtgcctgtcgccattcagctcgatgccagtgaggacccagtcaactacgtccgcaaggactcgcgggtgtacacccccaacgaggagcacgagtacgactggctgtttgcaaagatctgtgtccaggtggcagactctctgcaccacgagatgggctcccatctcgctcgctgccacttcacgatggaaccgatcgccgtgtgtgttcaccggacgatggcagaagagcaccccatcgctctgctcctgaacctgcacatgcggttccacattgccaacgactcggtcgcggcttacacactcattggtccttctggcaacgttgatgacttgatgcctggaaccctgcgcgagtccatggcgctactgacggagtcatacgacaagtgggacctcatcggcaccaactttgagaacgacctcttcaaccgcgaggtgaacgatgatgaacgcctgccccactacccctaccgtgacgatggcaagctcatctggaagatcatcgaggactgggtggagaaatacgtaaatgccttctacgacaacgatgatgaggttgagggcgatcctgagctgcaggcgttcgccaaggagtgcaaggacaagaaggaaggtggccgggtgaagggtatgccggagacgatccgcagccgtagcatgcttgttgaaatcctcaccagcatcatctttgtgtgtggccctggccacggagctatcaacttctcgcaatacgactatatgtcgttcgtgcccaacatgccactcgcgatttatgaggatatccagctgctcgcagaccaaaaggagccggttacggaggcgcagctcatgtcgatcctgccagacggtgaaaccgcagcccgccagcttgagattgtatacaacctgaccgcctacaagttcgataagttcggggattatgacaggaccttcaaggagtggtacggcgagacctttgaagcccatttcaaggactacccgctcgtgatccagggctatcggcagctccaggttgcgctgaggcagtcggaggtggagattaagaagcgcaacgccaaacgcccgaacaactatccgtacatgcagcagagcgagatgttgaacagcatcagcatttaa

SEQ ID NO: 17 - DNA, 1749 bp, Artificial Sequence
  Codon-optimized coding sequence of UfLOX2
atgccgagcatcaaaccgtgcctgccgggtgacagcgcgaacagcgcggcgcgtaccgcgagcatcaaagaaaagcgtgcgcagattggttacgattataaaatgctgccgaagctggcgctggcgagcgctccgccggcgaagttcgtggagctgagcgacgcgtatatggcggagcgtattggtgaaaccgcgaaattctttaaaaacaaggagatgaccaaggcgcgtcgtatgtttgatgtggttaaccgtatggaagacttcaacgattactttattctgccgccggtgattgcgccggagcacgcgaagggcaagtggatggaggacgatttctttgcggaacagcgtctgagcggtgcgaacccgctggttctggcgaaactggaccgtgacgatgcgcgtgcggagatcctggaagacatgaacctggatttcagcgtgaacagcgaactgagccgtggcaacatttacgtttgcgactataccggcaccgatccgacctaccgtggtccgtgcatggttaccggtggcgaaaacaacagcggtaagaaaaagtggctgccgaaaccgctgagctggtttcgttggatcgaggacgataaaaacaaagtgggtggcaagctggtgccggttgcgattcagctggacgcgagcgaagatccggtgaactacgttcgtaaagacagccgtgtttataccccgaacgaggaacacgagtacgactggctgttcgcgaagatctgcgtgcaagttgcggatagcctgcatcatgagatgggtagccacctggcgcgttgccactttaccatggaaccgatcgcggtgtgcgttcaccgtaccatggcggaggaacacccgattgcgctgctgctgaacctgcacatgcgtttccacatcgcgaacgatagcgtggcggcgtataccctgattggcccgagcggtaacgttgacgatctgatgccgggcaccctgcgtgagagcatggcgctgctgaccgaaagctacgacaagtgggatctgatcggcaccaacttcgaaaacgacctgtttaaccgtgaggtgaacgacgatgaacgtctgccgcactacccgtatcgtgacgatggtaaactgatttggaagatcattgaggattgggtggaaaaatacgttaacgcgttctatgacaacgacgatgaggtggaaggcgatccggagctgcaggcgtttgcgaaagagtgcaaggacaaaaaggaaggtggccgtgttaagggtatgccggagaccatccgtagccgtagcatgctggttgagattctgaccagcatcattttcgtttgcggtccgggccacggtgcgatcaacttcagccaatacgattatatgagctttgtgccgaacatgccgctggcgatctacgaggacattcagctgctggcggatcaaaaagagccggttaccgaagcgcagctgatgagcattctgccggatggtgaaaccgcggcgcgtcaactggaaattgtgtacaacctgaccgcgtataaattcgataagtttggcgactatgatcgtacctttaaagaatggtacggcgagaccttcgaagcgcactttaaggactacccgctggttatccagggttatcgtcagctgcaagtggcgctgcgtcaaagcgaggttgaaattaaaaagcgtaacgcgaagcgtccgaacaactacccgtatatgcagcaaagcgagatgctgaacagcatcagcatttaa

SEQ ID NO: 18 - protein, 582 aa, Ulva fasciata
MPSIKPCLPGDSANSAARTASIKEKRAQIGYDYKMLPKLALASAPPAKFVELSDAYMAERIGETAKFFKNKEMTKARRMFDVVNRMEDFNDYFILPPVIAPEHAKGKWMEDDFFAEQRLSGANPLVLAKLDRDDARAEILEDMNLDFSVNSELSRGNIYVCDYTGTDPTYRGPCMVTGGENNSGKKKWLPKPLSWFRWIEDDKNKVGGKLVPVAIQLDASEDPVNYVRKDSRVYTPNEEHEYDWLFAKICVQVADSLHHEMGSHLARCHFTMEPIAVCVHRTMAEEHPIALLLNLHMRFHIANDSVAAYTLIGPSGNVDDLMPGTLRESMALLTESYDKWDLIGTNFENDLFNREVNDDERLPHYPYRDDGKLIWKIIEDWVEKYVNAFYDNDDEVEGDPELQAFAKECKDKKEGGRVKGMPETIRSRSMLVEILTSIIFVCGPGHGAINFSQYDYMSFVPNMPLAIYEDIQLLADQKEPVTEAQLMSILPDGETAARQLEIVYNLTAYKFDKFGDYDRTFKEWYGETFEAHFKDYPLVIQGYRQLQVALRQSEVEIKKRNAKRPNNYPYMQQSEMLNSISI

SEQ ID NO: 19 - DNA, 1773 bp, Artificial Sequence
  Codon-optimized coding sequence for WP_002738122.1
atggtgaacaccccgccgccgaccccgtgcctgccgcagaacgagccggatgcgaaccgtcgtgcggatagcctgaacctgcagcgtcaagcgtaccgttatgactaccagtatctgccgccgctggtgctgatggagagcgttccggcggcggaaaacttcagctttcaatatattaccgaacgtctggcggcgaccgcggaactgccggcgaacatgctggcggtgaaggttaaaagcttcctggacccgctggatgagctgcaggactacgaagatttctttgcgatcattccgctgccgaagatcgcgaaagtgtatcagaccaacgatgcgtttgcggaacaacgtctgagcggtgcgaacccgctggttctgcacctgctgaagccgggtgatgcgcgtgcgcaggttctgaaccaaattccgagcagcaaaaccgatttcgagccgctgtttcaggttaaccaagaactggcggcgggcaacatctacattgcggactataccggcaccgatatcaactacctgggtccgagcctgattcagggtggcacccacgcgaagggtcgtaaatatctgccgaagccgcgtgcgttcttttggtggcgtaagagcggcatccgtgaccgtggtaaactggtgccgatcgcgattcagttcggcgagaacgcggaaaagctgtacaccccgttcgagaaaaacccgctggcgtggctgtttgcgaagatttgcgtgcaagttgcggatagcaaccaccacgaaatgaacagccacctgtgccgtacccacttcgttatggagccgattgcgattggcaccgcgcgtcagctggcggaaaaccacccgctgagcctgctgctgaaaccgcacctgcgttttatgctgaccaacaaccacctgggtcaagagcgtctgatcaacccgggtggcccggtggatgagctgctggcgggcaccctgggtgaaagcatggcgctggttaaggacgcgtacgcgaactggaacctgcgtgatttcgcgtttccgaaagagattagcaaccgtggcatggacgataccgaacgtctgccgcactacccgtatcgtgacgatggtatgctggtgtggcagagcatcaaccaattcgttagcgactacctgcactacttttatccgaacccgcaggacattaccaacgatcaggagctgcaagcgtgggcgggtgaactgagcaacagcgcggcggatcaaggtggcaacgtgaagggtatgccggcgaacttcaccgacgttgaggatctgatcgaagtggttaccaccatcatttttatttgcggcccgctgcacagcgcggttaactacggccagtacgactatatgacctttgcggcgaacatgccgctggcggcgtattgcgacctgccggaggcgatcaaggataccaccggtagcatcattggcgacgcgcgtggtagcatcaccgaaaaagatattctgcagctgctgccgccgtacaagaaagcggcggatcagctgcaaagcctgttcaccctgagcgactaccgttatgatcaactgggctactatgacaaggcgtttcgtgagctgtatggtcgtaaattcgaggaagtgtttgcggaaggcgatcaggcgaccatcaccggtttcctgcgtcaatttcagcaaaacctgaacatgaacgagcaggaaatcgacgcgaacaaccaaaagcgtattgttccgtacacctatctgaaaccgagcctgattctgaacagcatcagcatttaa

SEQ ID NO: 20 - protein, 590 aa, Microcystis aeruginosa
MVNTPPPTPCLPQNEPDANRRADSLNLQRQAYRYDYQYLPPLVLMESVPAAENFSFQYITERLAATAELPANMLAVKVKSFLDPLDELQDYEDFFAIIPLPKIAKVYQTNDAFAEQRLSGANPLVLHLLKPGDARAQVLNQIPSSKTDFEPLFQVNQELAAGNIYIADYTGTDINYLGPSLIQGGTHAKGRKYLPKPRAFFWWRKSGIRDRGKLVPIAIQFGENAEKLYTPFEKNPLAWLFAKICVQVADSNHHEMNSHLCRTHFVMEPIAIGTARQLAENHPLSLLLKPHLRFMLTNNHLGQERLINPGGPVDELLAGTLGESMALVKDAYANWNLRDFAFPKEISNRGMDDTERLPHYPYRDDGMLVWQSINQFVSDYLHYFYPNPQDITNDQELQAWAGELSNSAADQGGNVKGMPANFTDVEDLIEVVTTIIFICGPLHSAVNYGQYDYMTFAANMPLAAYCDLPEAIKDTTGSIIGDARGSITEKDILQLLPPYKKAADQLQSLFTLSDYRYDQLGYYDKAFRELYGRKFEEVFAEGDQATITGFLRQFQQNLNMNEQEIDANNQKRIVPYTYLKPSLILNSISI

SEQ ID NO: 21 - DNA, 1716 bp, Artificial Sequence
  Codon-optimized coding sequence for WP_006635899.1
atggtggataacatgaagccgctgctgccgcaagacgatccgaacccggaacagcgtcacgacagcctgaaccgtcagcaacaggcgtaccaattcgattatgaaagcctgagcccgctggcgctgctgaaggatgtgccggcggttgagaactttagcagcaaatacctggcggagcgtatcctggcgaccagcgaactgccggcgaacatgctggcggcggacagccgtaccttcctggacccgctggatgagctgcaggactacgaagatttctttacctggctgccgctgccgggtgtggcgaaaatctatcaaaccgatcgtagctttgcggaacagcgtctgagcggtgcgaacccgatggttctgcgtctgctgcaccaagaggacagccgtgcggaaaccctggcgcaactgtgctgcctgcagccgctgttcgacctgcgtaaggagctgcaggataaaaacatctacattgcggactataccggcaccgatgaacactatcgtggtccggcgaaggttgcgggtggcacctacgagaagggtcgtaaatatctgccgaaaccgcgtgcgttctttgcgtggcgttggaccggtatccgtgatcgtggcgagatgaccccgatcgcgattcaactggacccgaagccgggtagccacctgtacaccccgtttgacccgccgattgattggctgtatgcgaaactgtgcgtgcaggttgcggacgcgaaccaccacgaaatgagcagccacctgggccgtacccacctggtgatggagccgatcgcgattgttaccgcgcgtcagctggcgaagaaccacccgctgagcctgctgctgaaaccgcacttccgttttatgctgaccaacaacgatctggcgcgtagccatctgattgcgccgggtggcccggtggatgaactgctgggtggcaccctggcggagaccatggaactgacccgtgaggcgtgcagcacctggagcctggatgagtttgcgctgccggcggaactgaagaaccgtggtatggacgatccgaaccagctgccgcactacccgtatcgtgacgatggcctgctgctgtgggatgcgatcgaaacctttgttagcggttacctgaagttcttttatccgaccaacgagggcattgtgcaagacgttgaactgcagacctgggcgaaagagctggcgagcgacgatggtggcaaggtgaagggtatgccgcaccacatcgacaccgttgagcagctgatcgcgattgtgaccaccgttattttcacctgcggcccgcaacacagcgcggtgaacttcccgcagtacgattatatgagctttgcggcgaacatgccgctggcggcgtaccgtgacatcccgggtattaccgcgagcggccacctggaagtgatcaccgaaaacgatattctgcgtctgctgccgccgtataagcgtgcggcggaccaactgcagatcctgttcattctgagcgcgtaccgttatgaccgtctgggttactatgataaaagctttcgtgaactgtaccgtatgagcttcgatgaggtgtttgcgggcaccccgatccaactgctggcgcgtcagttccaacagaacctgaacatggcggaacaaaagatcgacgcgaacaaccagaaacgtgtgattccgtattttgcgctgaaaccgagcctggttctgaacagcattagcatgtaa

SEQ ID NO: 22 - protein, 571 aa, Microcoleus vaginatus
MVDNMKPLLPQDDPNPEQRHDSLNRQQQAYQFDYESLSPLALLKDVPAVENFSSKYLAERILATSELPANMLAADSRTFLDPLDELQDYEDFFTWLPLPGVAKIYQTDRSFAEQRLSGANPMVLRLLHQEDSRAETLAQLCCLQPLFDLRKELQDKNIYIADYTGTDEHYRGPAKVAGGTYEKGRKYLPKPRAFFAWRWTGIRDRGEMTPIAIQLDPKPGSHLYTPFDPPIDWLYAKLCVQVADANHHEMSSHLGRTHLVMEPIAIVTARQLAKNHPLSLLLKPHFRFMLTNNDLARSHLIAPGGPVDELLGGTLAETMELTREACSTWSLDEFALPAELKNRGMDDPNQLPHYPYRDDGLLLWDAIETFVSGYLKFFYPTNEGIVQDVELQTWAKELASDDGGKVKGMPHHIDTVEQLIAIVTTVIFTCGPQHSAVNFPQYDYMSFAANMPLAAYRDIPGITASGHLEVITENDILRLLPPYKRAADQLQILFILSAYRYDRLGYYDKSFRELYRMSFDEVFAGTPIQLLARQFQQNLNMAEQKIDANNQKRVIPYFALKPSLVLNSISM

SEQ ID NO: 23 - DNA, 1716 bp, Artificial Sequence
  Codon-optimized coding sequence for WP_015178512.1
atggtggacaacatgaagccgagcctgccgcaagacgatccgaaccaagaacagcgtaaagacagcctgaaccgtcagcaacaggcgtaccagttcgattatgagagcctgagcccgctggcgctgctgaagaacgtgccggcggttgaaaactttagcagcaaatacatcggcgagcgtattctggcgaccagcgaactgccggcgaacatgctggcggcggacagccgtaccttcctggacccgctggatgagctgcaagactacgaagatttctttaccctgctgccgctgccggcggtggcgaagatttatcaaaccgatcgtagctttgcggaacagcgtctgagcggtgcgaacccgatggttctgcgtctgctggatgcgggtgatccgcgtgcgcaaaccctggcgcagatcagcagcttccacccgctgtttgacctgggccaggagctgcaacagaaaaacatttacgttgcggactataccggcaccgatgagcactaccgtgcgccgagcaagatcggtggcggtagctatgaaaagggccgtaaattcctgccgaaaccgcgtgcgttctttgcgtggcgttggaccggcatccgtgaccgtggtgagatgaccccgatcgcgattcaactggacccgaccccggatagccatgtgtacaccccgtttgacccgccggttgattggctgtttgcgaagctgtgcgtgcaggttgcggatgcgaaccaccacgagatgagcagccacctgggtcgtacccacctggtgatggaaccgatcgcgattgttaccgcgcgtcaactggcgcagaaccacccgctgagcctgctgctgaaaccgcacttccgttttatgctgaccaacaacgagctggcgcgtagctatctgattgcgccgggcggtccggtggatgaactgctgggtggcaccctgccggagaccatggaaattgcgcgtgaggcgtgcagcacctggagcctggatgagtttgcgctgccggcggaactgaagaaccgtggcatggacgataccaaccagctgccgcactacccgtatcgtgacgatggcctgctgctgtgggacgcgattgagacctttgttagcggttacctgaaattcttttatccgaccgaaatcgcgattgtgcaagacgttgagctgcaaacctgggcgcaggaactggcgagcgatcgtggcggtaaagtgaaaggcatgccgccgcgtatcaacaccgtggaacagctgatcaagattgttaccaccatcattttcacctgcggtccgcaacacagcgcggttaacttcccgcagtacgagtatatgagctttgcggcgaacatgccgctggcggcgtaccgtgatatcccgaagattaccgcgagcggtaacctggaagtgatcaccgaaaaagacattctgcgtctgctgccgccgtataagcgtgcggcggatcagctgaaaatcctgttcaccctgagcgcgtaccgttatgaccgtctgggctactatgataagagctttcgtgagctgtaccgtatgagcttcgacgaagtttttgcgggcaccccgattcaactgctggcgcgtcagtttcaacagaacctgaacatggcggaacaaaagatcgatgcgaacaaccagaaacgtgtgatcccgtatattgcgctgaaaccgagcctggttatcaacagcattagcatgtaa

SEQ ID NO: 24 - protein, 571 aa, Oscillatoria nigro-viridis
MVDNMKPSLPQDDPNQEQRKDSLNRQQQAYQFDYESLSPLALLKNVPAVENFSSKYIGERILATSELPANMLAADSRTFLDPLDELQDYEDFFTLLPLPAVAKIYQTDRSFAEQRLSGANPMVLRLLDAGDPRAQTLAQISSFHPLFDLGQELQQKNIYVADYTGTDEHYRAPSKIGGGSYEKGRKFLPKPRAFFAWRWTGIRDRGEMTPIAIQLDPTPDSHVYTPFDPPVDWLFAKLCVQVADANHHEMSSHLGRTHLVMEPIAIVTARQLAQNHPLSLLLKPHFRFMLTNNELARSYLIAPGGPVDELLGGTLPETMEIAREACSTWSLDEFALPAELKNRGMDDTNQLPHYPYRDDGLLLWDAIETFVSGYLKFFYPTEIAIVQDVELQTWAQELASDRGGKVKGMPPRINTVEQLIKIVTTIIFTCGPQHSAVNFPQYEYMSFAANMPLAAYRDIPKITASGNLEVITEKDILRLLPPYKRAADQLKILFTLSAYRYDRLGYYDKSFRELYRMSFDEVFAGTPIQLLARQFQQNLNMAEQKIDANNQKRVIPYIALKPSLVINSISM

SEQ ID NO: 25 - DNA, 1929 bp, Artificial Sequence
  Codon-optimized coding sequence for WP_015204462.1
atgccgcaaccgtacctgccgcagaacgagccgaacccggaaaaacgtaacaacgacctgagcgatcagcaacaggcgtacgagtatgattacaagtatctgccgccgctggtgctgctgaagaaaattccggcgttcgaaaactttagcgcgcagtacatcgcggaacgtgtggttgcgaccagcgagctggttccgaacatgctggcggcgaaagcgcgtagctttctggacccgctggacgatatcaaggactacgaggacctgttcaccctgctgccgctgccggaagtggcgaaagtttatcaaaccaacaacagctttgcggagcagcgtctgagcggtgcgaacccgttcgtgattcgtctgctggacgaggacgatccgcgtagccaagttctggaacagatcccgagcttcaaagacgattttgagccgctgttcgatgtgcgtaaggaactggcggcgggtaacatctacattaccgactataccggcaccgatgagtactatcgtggcccgagcatggttcagggtggcacctacgaaaagggccgtaaatatctgccgaaaccgctggcgttcttttggtggcaacgtaccggtattagcgaccgtggcaagctggtgccgatcgcgattcagctggatgcgagcaagaacagcaaagtgtacaccccgaccaacagcaaagtttataccccgtttgagcaaaacccgctggactggctgttcgcgaagctgtgcgtgcagatcgcggatggtaaccaccacgaaatgagcagccacctgtgccgtacccacttcgttatggagccgattgcgattggcaccgcgcaccagctggcggaaaaccacccgctgagcctgctgctgcgtccgcacttcctgtttatgctgaccaacaaccacctgggccaacagcgtctgatcaacccgggtggcccggtggatgagctgctggcgggcaccctgccggagagcatggaactggttaaggatgcgtacgagggctggaacattaaagaattcgcgtttccgaccgagatcaagaaccgtggtatggacaacaccgaacgtctgccgcactacccgtatcgtgacgatggcatgctggtttggaaagcgattcacacctttgtgagcgattacgttaaccacttctatccgaccccggaagacatcaccggtgataccgagctgcaagcgtgggcgaaggaactgagcgaccaaagcgcgcagaccaacggtggcaaggtgaaaggcatgccgaccagctttaccaccgtgcaggagctgatcgaaattgttaccaccatcattttcatttgcggtccgcaacacagcgcggttaactacgcgcaggatggctatatgacctttgcggcgaacatgccgctggcggcgtaccgtgacatcccgaagcagagccacaaaccgcaggatcaaccgaccgcgaccccgagcgtggcggttcaaaccaccgcggagcagaccaccgcggaacaaaccaaggcggtggaaattaccgcggacaaagcgaccctggatcagaacaccgttctgcaaaaacgtgcggtgcagaccaccaccgttgagatcccggaagaccaaattaccgaggaacagatcctgaagctgctgccgccgtacaaacgtaccgcggaccaactgcagagcctgtttgtgctgagcgcgtaccaatatgatcgtctgggttactatgagaaggcgttccaacagctgtacaacgacaagttcgaagatgttttcaaggacgataacaaccaagcgatcattgcgattgtgcgtcagttccaacagaacctgaacatggttgagcaggaaatcgacgcgaacaacaagaaacgtgtggttccgtacctgtatctgaagccgagcctgatcctgaacagcatcagcatttaa

SEQ ID NO: 26 - protein, 642 aa, Crinalium epipsammum
MPQPYLPQNEPNPEKRNNDLSDQQQAYEYDYKYLPPLVLLKKIPAFENFSAQYIAERVVATSELVPNMLAAKARSFLDPLDDIKDYEDLFTLLPLPEVAKVYQTNNSFAEQRLSGANPFVIRLLDEDDPRSQVLEQIPSFKDDFEPLFDVRKELAAGNIYITDYTGTDEYYRGPSMVQGGTYEKGRKYLPKPLAFFWWQRTGISDRGKLVPIAIQLDASKNSKVYTPTNSKVYTPFEQNPLDWLFAKLCVQIADGNHHEMSSHLCRTHFVMEPIAIGTAHQLAENHPLSLLLRPHFLFMLTNNHLGQQRLINPGGPVDELLAGTLPESMELVKDAYEGWNIKEFAFPTEIKNRGMDNTERLPHYPYRDDGMLVWKAIHTFVSDYVNHFYPTPEDITGDTELQAWAKELSDQSAQTNGGKVKGMPTSFTTVQELIEIVTTIIFICGPQHSAVNYAQDGYMTFAANMPLAAYRDIPKQSHKPQDQPTATPSVAVQTTAEQTTAEQTKAVEITADKATLDQNTVLQKRAVQTTTVEIPEDQITEEQILKLLPPYKRTADQLQSLFVLSAYQYDRLGYYEKAFQQLYNDKFEDVFKDDNNQAIIAIVRQFQQNLNMVEQEIDANNKKRVVPYLYLKPSLILNSISI

SEQ ID NO: 27 - DNA, 1647 bp, Artificial Sequence
  Codon-optimized coding sequence for WP_028091425.1
atgcagccgttcctgccgcaaaacgacccgaacccgagccagcgtcaaagcagcctggagaagggtcgtaaggaataccagttcatgtacgattttctgccgccgatggcgatgatcaagagcgtgccgccggcggagaactttagcaccaaatacattgcggaacgtaccctggaggcggcggaactgccgctgaacatgatggcggttaagacccacgcgatgtgggacccgctggatgagctgcaggactacgaagatttctttccggtgctgcaaaagccgaacgttatgaaaacctatgagaccgacgatagcttcgcggaacagcgtctgtgcggcgtgaacccgatggttctgcgtcagatcaagcaaatgccggcgaacttcgcgtttaccattgaggaactgcaagacaaattcggtagcagcatcaacctgattgagcgtctggcgaccggcaacctgtacgtggcggattatcgtagcctggcgtttatccagggtggcacctacgcgaagggtaagaaatatctgccggcgccgctggcgttcttttgctggcgtaccagcggtttccaggaccgtggccaactggtgccggttgcgatccagattaacccgaaagcgggtaaagcgagcccgctgctgaccccgtttgatgatccgctgacctggttttacgcgaaaagctgcgtgcaaatcgcggatgcgaaccaccacgagatgagcagccacctgtgccgtacccacctggttatggagccgtttgcggtggttaccccgcgtcagctggcggaaaaccacccgctgcgtattctgctgaagccgcacttccgttttatgctggcgaacaacgacctggcgcgtaaacgtctggttagccgtggtggcttcgttgatgagctgctggcgggcaccctgcaggaaagcctgcaaatcgtggttgacgcgtacaaaagctggagcctggatcagtttgcgctgccgcgtgaactgaagaaccgtggtgtgaacgacgttaaaaacctgccgcactacccgtatcgtgacgatggcatcctgctgtggaacgcgattaacaagttcgtttttaactatctgcagctgtactatcaaagcagcgcggacctgaaggcggatgcggaactgcaggcgtgggcgcgtgaactggtggcgcaagatggtggccgtgttaagggtatgagcgaccgtatcgataccctggagcagctggttgagatcgttaccaccatcatttacatttgcggcccgcagcacagcgcggtgaacttcagccaatacgaatatatgggctttattccgaacatgccgctggcggcgtatcagccgatccagcaaaagggtgacattaaagatcgtcaagcgctgatcgacttcctgccgccggcgaaaccgaccagcacccagctgagcaccgtttacattctgagcgactaccgttatgatcgtctgggctactatgaggaagaggaattcaccgacccgaacgcggatcaggtggttaacaagtttcagcaagagctgaacatggtgcagcgtaagatcgaactgaacaacaaacgtcgtctggttaactacaaatatctgcaaccgcgtctgattctgaacagcatcagcatttaa

SEQ ID NO: 28 - protein, 548 aa, Dolichospermum circinale
MQPFLPQNDPNPSQRQSSLEKGRKEYQFMYDFLPPMAMIKSVPPAENFSTKYIAERTLEAAELPLNMMAVKTHAMWDPLDELQDYEDFFPVLQKPNVMKTYETDDSFAEQRLCGVNPMVLRQIKQMPANFAFTIEELQDKFGSSINLIERLATGNLYVADYRSLAFIQGGTYAKGKKYLPAPLAFFCWRTSGFQDRGQLVPVAIQINPKAGKASPLLTPFDDPLTWFYAKSCVQIADANHHEMSSHLCRTHLVMEPFAVVTPRQLAENHPLRILLKPHFRFMLANNDLARKRLVSRGGFVDELLAGTLQESLQIVVDAYKSWSLDQFALPRELKNRGVNDVKNLPHYPYRDDGILLWNAINKFVFNYLQLYYQSSADLKADAELQAWARELVAQDGGRVKGMSDRIDTLEQLVEIVTTIIYICGPQHSAVNFSQYEYMGFIPNMPLAAYQPIQQKGDIKDRQALIDFLPPAKPTSTQLSTVYILSDYRYDRLGYYEEEEFTDPNADQVVNKFQQELNMVQRKIELNNKRRLVNYKYLQPRLILNSISI

SEQ ID NO: 29 - DNA, 1647 bp, Artificial Sequence
  Codon-optimized coding sequence for OBQ01436.1
atgcagccgttcctgccgcaaaacgacccgaacccggcgcagcgtcaaagctgcctggagaagggtcgtaaggaataccagttcatgtacgattttctgccgccgatggcgatgctgaagagcgttccgccggcggagaactttagcaccaaatacatcgcggaacgtaccctggaggcggcggaactgccgctgaacatgatggcggtgaagacccacgcgatgtgggacccgctggatgagctgcaggactacgaagatttctttccgattctgcaaaagccgaacgttatgaaaacctatgagaccgacgatagcttcgcggaacagcgtctgtgcggcgtgaacccgatggttctgcgtcagatcaagcaaatgccggcgaacttcgcgtttaccattgaggaactgcaagcgaaattcggtaacagcatcaacctgattgagcgtctggcgaccggcaacctgtacgtggcggactatcgtagcctggcgtttatccagggtggcacctacgcgaagggtaagaaatatctgccggcgccgctggcgttcttttgctggcgtagcagcggtttccaggatcgtggccaactggtgccggttgcgatccagattaacccgaaagcgggtaaagcgagcccgctgctgaccccgtttgatgatccgctgacctggttttacgcgaaaagctgcgtgcaaatcgcggacgcgaaccaccacgagatgagcagccacctgtgccgtacccacctggttatggagccgtttgcggtggttaccccgcgtcagctggcggaaaaccacccgctgcgtattctgctgcgtccgcacttccgttttatgctggcgaacaacgacctggcgcgtaagcgtctggttagccgtggtggcttcgttgatgagctgctggcgggcaccctgcaggaaagcctgcaaatcgtggttgacgcgtacaaaagctggagcctggatcagtttgcgctgccgcgtgaactgaagaaccgtggtgtggacgatgttaaaaacctgccgcactacccgtatcgtgacgatggcatcctgctgtggaacgcgattaacaagttcgtttttaactatctgcagctgtactataagagcccggcggacctgaaggcggatggtgaactgcaggcgtgggcgcgtgaactggtggcgcaagacggtggccgtgttaaaggcatgagcgaccgtatcgataccctggagcaactggtggaaatcgttaccaccatcatttacatttgcggcccgcagcacagcgcggtgaacttcagccaatacgagtatatgggctttattccgaacatgccgctggcggcgtatcaggagatccagcaaaacggtgacattgaagatcgtcaagcgctgatcgatttcctgccgccggcgaagccgaccaacacccagctgagcaccgtttacattctgagcgactaccgttatgatcgtctgggctactatgaggaagaggaattcaccgacccgaacgcggatcaggtggttaacaaatttcagcaagagctgagcgtggttcagcgtaagatcgaactgaacaacaaaggtcgtctggtgaactacgaatatctgcaaccgggcctgattctgaacagcatcagcatttaa

SEQ ID NO: 30 - protein, 548 aa, Anabaena sp. AL09
MQPFLPQNDPNPAQRQSCLEKGRKEYQFMYDFLPPMAMLKSVPPAENFSTKYIAERTLEAAELPLNMMAVKTHAMWDPLDELQDYEDFFPILQKPNVMKTYETDDSFAEQRLCGVNPMVLRQIKQMPANFAFTIEELQAKFGNSINLIERLATGNLYVADYRSLAFIQGGTYAKGKKYLPAPLAFFCWRSSGFQDRGQLVPVAIQINPKAGKASPLLTPFDDPLTWFYAKSCVQIADANHHEMSSHLCRTHLVMEPFAVVTPRQLAENHPLRILLRPHFRFMLANNDLARKRLVSRGGFVDELLAGTLQESLQIVVDAYKSWSLDQFALPRELKNRGVDDVKNLPHYPYRDDGILLWNAINKFVFNYLQLYYKSPADLKADGELQAWARELVAQDGGRVKGMSDRIDTLEQLVEIVTTIIYICGPQHSAVNFSQYEYMGFIPNMPLAAYQEIQQNGDIEDRQALIDFLPPAKPTNTQLSTVYILSDYRYDRLGYYEEEEFTDPNADQVVNKFQQELSVVQRKIELNNKGRLVNYEYLQPGLILNSISI

SEQ ID NO: 31 - DNA, 1659 bp, Artificial Sequence
  Codon-optimized coding sequence for OBQ25779.1
atgatcaacattatgcagccgttcctgccgcaaaacgacccgaacccgggtcagcgtcaaagcagcctggagaagggccgtaaggaataccagttcatgtacgattttctgccgccgatggcgatgctgaagagcgtgccgccggcggagaactttagcaccaaatacatcgcggaacgtaccctggaggcggcggaactgccgctgaacatgatggcggttaagacccacgcgatgtgggacccgctggatgagctgcaggactacgaagatttctttccggtgctgcaaaagccgaacgttatgaaaacctatgagaccgacgatagcttcgcggaacagcgtctgtgcggtgtgaacccgatggttctgcgtcagatcaagcaaatgccggcgaacttcgcgtttaccattgaggaactgcaagcgaaattcggtaacagcatcaacctgattgagcgtctggcgaccggcaacctgtacgttgcggactatcgtagcctggcgtttatccagggtggcacctacgcgaagggtaagaaatatctgccggcgccgctggcgttcttttgctggcgtagcagcggtttccaggatcgtggccaactggtgccggttgcgatccagattaacccgaaagcgggtcaagcgagcccgctgctgaccccgtttgacaagccgctgacctggttttacgcgaaaagctgcgtgcagatcgcggatgcgaaccaccacgagatgagcagccacctgtgccgtacccacctggttatggagccgtttgcggtggttaccccgcgtcaactggcggaaaaccacccgctgcgtattctgctgaagccgcacttccgttttatgctggcgaacaacgacctggcgcgtaaacgtctggttagccgtggtggcttcgttgatgagctgctggcgggcaccctgcaggaaagcctgcaaatcgtggttgacgcgtacaaaagctggagcctggatcagtttgcgctgccgcgtgaactgaagaaccgtggtgtggacgatgttaaaaacctgccgcactacccgtatcgtgacgatggcatcctgctgtggaacgcgattaacaagttcgtgtttaactatctgcagctgtactataagagcccggcggacctgaaggcggatggtgaactgcaggcgtgggcgcgtgaactggtggcgcaagacggtggccgtgttaaaggcatgagcgaccgtatcgataccctggagcaactggtggaaatcgttaccaccatcatttacatttgcggcccgcagcacagcgcggtgaacttcagccaatacgagtatatgggctttattccgaacatgccgctggcggcgtatcaggcgatccagcaaaagggcgacattaaagatcgtcaagcgctgatcgacttcctgccgccggcgaagccgaccaacacccagctgagcaccgtttacattctgagcgactaccgttatgatcgtctgggttactatgaggaagaggaattcaccgacccgaacgcggatcaggtggttaacaaatttcagcaagagctgaacgtggttcagcgtaagatcgaactgaacaacaaaggccgtctggtgaactacgaatatctgcagccgcgtctgattctgaacagcatcagcatttaa

SEQ ID NO: 32 - protein, 552 aa, Aphanizomenon flos-aquae
MINIMQPFLPQNDPNPGQRQSSLEKGRKEYQFMYDFLPPMAMLKSVPPAENFSTKYIAERTLEAAELPLNMMAVKTHAMWDPLDELQDYEDFFPVLQKPNVMKTYETDDSFAEQRLCGVNPMVLRQIKQMPANFAFTIEELQAKFGNSINLIERLATGNLYVADYRSLAFIQGGTYAKGKKYLPAPLAFFCWRSSGFQDRGQLVPVAIQINPKAGQASPLLTPFDKPLTWFYAKSCVQIADANHHEMSSHLCRTHLVMEPFAVVTPRQLAENHPLRILLKPHFRFMLANNDLARKRLVSRGGFVDELLAGTLQESLQIVVDAYKSWSLDQFALPRELKNRGVDDVKNLPHYPYRDDGILLWNAINKFVFNYLQLYYKSPADLKADGELQAWARELVAQDGGRVKGMSDRIDTLEQLVEIVTTIIYICGPQHSAVNFSQYEYMGFIPNMPLAAYQAIQQKGDIKDRQALIDFLPPAKPTNTQLSTVYILSDYRYDRLGYYEEEEFTDPNADQVVNKFQQELNVVQRKIELNNKGRLVNYEYLQPRLILNSISI

SEQ ID NO: 33 - DNA, 1644 bp, Artificial Sequence
  Codon-optimized coding sequence for WP_039200563.1
atgaagccgttcctgccgcagaacgatccgaacccgacccagcgtcaaagcagcctggagaagggccgtaaagagtacgaattccgttatgactttctgccgccgatggcgatgctgaagaacgtgccgccgagcgagaactttagcaccaaatacattgcggaacgtaccatcgagaccgcggaactgccgagcaacatgatggcggttaaagcgcacgcgatgtgggacccgctggatgagctgcaggactacgaagatttctttccggtgctgcaaaagccgaacgttatgaaaaactatgagaccgacgatagcttcgcggaacagcgtctgtgcggtgtgaacccggtggttctgtgccagattaagcaaatgccggcgaacttcgcgtttaccatcgaggaactgcaagcgaaatttggtaacagcattgatctgcgtgagcgtctggcgaccggcaacctgtacgtggcggactatcgtccgctggcgttcatccgtggtggcacctttgcgaagggtaagaaatacctgccggcgccgctggcgttcttttgctggcgtagcagcggtttccaggatcgtggccaactggttccgatcgcgattcagatcaacccgaaggaaggcaaagcgagcccgctgctgaccccgttcgacgatagcagcacctggttttacgcgaagagctgcgtgcaaatcgcggacgcgaaccaccacgagatgagcagccacctgtgccgtacccacttcgttatggaaccgtttgcggtggttaccccgcgtcagctggcgcaaaaccacccgctgcgtattctgctgaaaccgcacttccgttttatgctggcgaacaacgatctgggtcgtcagcgtctggtgaaccgtggtggcccggttgatgagctgctggcgggcaccctgcaggaaagcctgcaaattgtggttgacgcgtacaccgattggcgtctggaccaattcgcgctgccgaccgagctgaagaaccgtggtgtggacgatgttaaaaacctgccgcactacccgtatcgtgacgatggcattctgctgtggaacgcgatcaacaagttcgtgttcaactacctggaactgtactacaagagcccggcggatctgaccgcggatgttgaactgcaggcgtgggcgcgtgaactggtggcgcaagatggtggccgtgttaagggtatgagcgaccgtattgataccctgaaacagctggttgagatcgttaccaccatcatttacacctgcggtccgctgcacagcgcggtgaacttcccgcagtacgaatatatgggctttatcccgaacatgccgctggcggcgtatcaaccgattaagaaagagggtgtttgcacccgtaaggaactgatcgacttcctgccggcggcgaaaccgaccagcagccagctgaccaccctgtttaccctgagcgcgtaccgttatgatcgtctgggctactatgaggaagaggaattcgaggacccgaacgcggacgatgtggttaacaaatttcagcaagagctgaacgtggttcagcgtaagatcgaactgagcaacaaaggtcgtctggttaactacgaatatctgcaaccgcgtctgattctgaacagcattagcatctaa

SEQ ID NO: 34 - protein, 547 aa, Aphanizomenon flos-aquae
MKPFLPQNDPNPTQRQSSLEKGRKEYEFRYDFLPPMAMLKNVPPSENFSTKYIAERTIETAELPSNMMAVKAHAMWDPLDELQDYEDFFPVLQKPNVMKNYETDDSFAEQRLCGVNPVVLCQIKQMPANFAFTIEELQAKFGNSIDLRERLATGNLYVADYRPLAFIRGGTFAKGKKYLPAPLAFFCWRSSGFQDRGQLVPIAIQINPKEGKASPLLTPFDDSSTWFYAKSCVQIADANHHEMSSHLCRTHFVMEPFAVVTPRQLAQNHPLRILLKPHFRFMLANNDLGRQRLVNRGGPVDELLAGTLQESLQIVVDAYTDWRLDQFALPTELKNRGVDDVKNLPHYPYRDDGILLWNAINKFVFNYLELYYKSPADLTADVELQAWARELVAQDGGRVKGMSDRIDTLKQLVEIVTTIIYTCGPLHSAVNFPQYEYMGFIPNMPLAAYQPIKKEGVCTRKELIDFLPAAKPTSSQLTTLFTLSAYRYDRLGYYEEEEFEDPNADDVVNKFQQELNVVQRKIELSNKGRLVNYEYLQPRLILNSISI

SEQ ID NO: 35 - DNA, 1644 bp, Artificial Sequence
  Codon-optimized coding sequence for WP_012407347.1
atgaagccgtacctgccgcagaacgacccggatccgaccaaacgtcagatcctgctggagcgtaaccaaggcgagtacgaattcgactatgattttctggtgccgatggcgatgctgaagaacgttccgagcattgagaacttcagcaccaaatatatcgcggaacgtaccctggagaccgcggaactgccgattaacatgctggcggtgaagacccgtagcctgtgggacccgctggatgagctgcaggactacgaagattattttccggttctgccgaagccgaacatcattaaaacctaccagagcgacgatagcttctgcgagcaacgtctgtgcggtgcgaacccgtttgtgctgcgtcgtattgaacagatgccggacggcttcgcgtttaccatcctggagctgcaagaaaagttcggtgatagcattaacctggttgagaaactggcgaacggcaacctgtacgtggcggactatcgtgcgctggcgttcgttaaaggtggcagctacgaacgtggtaagaaatttctgccgaccccgatcgcgttcttttgctggcgtagcagcggtttcagcgaccgtggccagctggtgccgatcgttattcaaatcaacccggcggatggcaagcagagccaactgatcaccccgttcgacgatccgctgacctggtttcacgcgaaactgtgcgtgcagattgcggacgcgaaccaccacgaaatgagcagccacctgtgccgtacccacttcgtgatggagccgtttgcgattgttaccgcgcgtcaactggcggaaaaccacccgctgagcctgctgctgaagccgcacttccgttttatgctggcgaacaacgacctggcgcgtaaacgtctgatcagccgtggtggcccggtggatgagctgctggcgggcaccctgcaggaaagcctgcaaattgtggttaacgcgtacaccgagtggagcctggaccagttcagcctgccgaccgaactgaagaaccgtggtatggacgatccggataacctgccgcactacccgtatcgtgacgatggcctgctgctgtggaacgcgattaagaaatttgttagcgagtatctgcagatctactataagaccccgcaagacctggcggaggatctggaactgcagagctgggtgcaagaactggttagccagagcggtggccgtgtgaaaggtattagcgaccgtatcaacaccctggaccaactggtggatattgcgaccgcggttatttttacctgcggtccgcagcatgcggcggttaactacagccaatacgagtatatgacctttatgccgaacatgccgctggcggcgtataaacagatgaccagcgaaggcaccatcccggatcgtaagagcctgctgagcttcctgccgccgagcaaacagaccgcggaccaactgagcattctgtttatcctgagcgcgtaccgttatgatcgtctgggctactatgacgataagttcctggacccggaggcgcaagatgttctggcgaaatttcagcaagaactgaacgaggcggaacgtgagattgaactgaacaacaagagccgtctgatcaactacaactatctgaaaccgcgtctggtgaccaacagcatcagcgtttaa

SEQ ID NO: 36 - protein, 547 aa, Nostoc punctiforme
MKPYLPQNDPDPTKRQILLERNQGEYEFDYDFLVPMAMLKNVPSIENFSTKYIAERTLETAELPINMLAVKTRSLWDPLDELQDYEDYFPVLPKPNIIKTYQSDDSFCEQRLCGANPFVLRRIEQMPDGFAFTILELQEKFGDSINLVEKLANGNLYVADYRALAFVKGGSYERGKKFLPTPIAFFCWRSSGFSDRGQLVPIVIQINPADGKQSQLITPFDDPLTWFHAKLCVQIADANHHEMSSHLCRTHFVMEPFAIVTARQLAENHPLSLLLKPHFRFMLANNDLARKRLISRGGPVDELLAGTLQESLQIVVNAYTEWSLDQFSLPTELKNRGMDDPDNLPHYPYRDDGLLLWNAIKKFVSEYLQIYYKTPQDLAEDLELQSWVQELVSQSGGRVKGISDRINTLDQLVDIATAVIFTCGPQHAAVNYSQYEYMTFMPNMPLAAYKQMTSEGTIPDRKSLLSFLPPSKQTADQLSILFILSAYRYDRLGYYDDKFLDPEAQDVLAKFQQELNEAEREIELNNKSRLINYNYLKPRLVTNSISV

SEQ ID NO: 37 - DNA, 1659 bp, Artificial Sequence
  Codon-optimized coding sequence for WP_027843955.1
atgaagccgtacctgccgcagaacgacccgaacccggagaagcgtaaagattggctgaacaaaaaccgtgaggaataccaattcaactttaactatctgagcccgctgccgctgatcgacgatgttccgaacaacgaggcgtttagcccgaagtacctggcggaacgtctgccgctgaccttcggtaaactgagcgcgaacaccctgggcattcgtctgcgtagcttttgggacccgttcgatgagtttcaggactatgaagatttctttccggtgctgccgaccccggaactgctgaagacctaccagaacgacgagtatttcgcggaacaacgtctgagcggtgtgaacccgatggttatccgtagcattaaagagctgccgccgcacttcgcgtttagcatccgtgacctgcaggcggaattcggcaccagcctgaacctggagcaagaactgaacaacggcaacctgtacattgcggattataccagcctgagctttgttcgtggtggcagctacctgcgtggtcgtaagagcctgccggcgccgattgcgctgttctgctggcgtaacagcggttattgcgatcgtggcgagctgaccccgatcgcgattcaactggtgccggaactgggcaccggtagccgtattctgaccccgtttgacagccacctgaactggctgtacgcgaaaatctgcatgcaaattgcggatgcgaaccaccacgagatgagcagccacctgtgccacacccacctggttatggagccgtttgcggtggttaccgcgcgtcagctggcggaaaaccacccgctgggtctgctgctgcgtccgcacttccgttttatgctgcacaacaacgagctggcgcgtaagaacctgatcaaccagggtggctacgttgacaacctgctgggtggcaccctgcgtgaaagcctgcaaattgtgcgtgacgcgtatttcaagaacgcggaggaattttggagcctggatgagttcgcgctgccgaaagaaatcgcgaaccgtggtctggacgataccgatcgtctgccgcactacccgtatcgtgacgatggcatgctgctgtggaacgcgattgaaaagtttgttagcaactacctgagcatctactatccgaacccgggtgacattaaagatgatcgtgagctgcaagcgtgggcggcggaactggtggcggcggatggtggccgtgtgaagggcgttccgagccaatttgagaacctgcagcaactgatcgacgtggttaccggtatcatttttacctgcggtccgcagcacagcgcggtgaactacccgcaatacgaatatatggcgtttgttccgaacatgccgctggcgggttatcaggcggtggacagcaacccgaacatggatctgaaaagcctgatggcgttcctgccgccgccgaaccaaaccgcggaccagctgcaaatcatttacggtctgagcgcgtaccgttatgatcgtctgggctactatgaccgtgagtttagcgatccgcacgcggaggaagtggttcgtctgttccagcaagacctgaaccaggtggagcgtaagatcgaactgcgtaacaaaaaccgtctggtggaatataacttcctgaaaccgagcctggttctgaacagcatcagcatttaa

SEQ ID NO: 38 - protein, 552 aa, Mastigocoleus testarum
MKPYLPQNDPNPEKRKDWLNKNREEYQFNFNYLSPLPLIDDVPNNEAFSPKYLAERLPLTFGKLSANTLGIRLRSFWDPFDEFQDYEDFFPVLPTPELLKTYQNDEYFAEQRLSGVNPMVIRSIKELPPHFAFSIRDLQAEFGTSLNLEQELNNGNLYIADYTSLSFVRGGSYLRGRKSLPAPIALFCWRNSGYCDRGELTPIAIQLVPELGTGSRILTPFDSHLNWLYAKICMQIADANHHEMSSHLCHTHLVMEPFAVVTARQLAENHPLGLLLRPHFRFMLHNNELARKNLINQGGYVDNLLGGTLRESLQIVRDAYFKNAEEFWSLDEFALPKEIANRGLDDTDRLPHYPYRDDGMLLWNAIEKFVSNYLSIYYPNPGDIKDDRELQAWAAELVAADGGRVKGVPSQFENLQQLIDVVTGIIFTCGPQHSAVNYPQYEYMAFVPNMPLAGYQAVDSNPNMDLKSLMAFLPPPNQTADQLQIIYGLSAYRYDRLGYYDREFSDPHAEEVVRLFQQDLNQVERKIELRNKNRLVEYNFLKPSLVLNSISI

SEQ ID NO: 39 - DNA, 1644 bp, Artificial Sequence
  Codon-optimized coding sequence for WP_073641301.1
atgaaaccgtacctgccgcagaacgacccggatccgattaagcgtaaatacagcctggagcacaagaaagaggaatatgaattcgaccacgattttctgagcccgatggcgatgctgaaagacgtgccggcggttgagaacttcagcacccgttatattgcggaacgtaccgtggagaccgcggaactgccgatcaacatgctggcggttaagacccgtgcgctgtgggacccgctggatgagctgcaggactacgaagattatttcccggtgctgccgaagccgaacgttatcaaaacctaccagaccgacgatagcttttgcgagcaacgtctgtgcggtgcgaacccgatggcgctgcagcaaatcaaagagatgccgctgggcttcgaatttaccattgaggaactgcaggagaaattcggtgaaagcatcaacctggtggagaagctggcggacggcaacctgtacgtgaccgattatcgtccgctgagctttgttaagggtggcacctacgaacgtggtaagaaatatctgccgaccccgctggcgttcttttgctggcgtagcagcggttttagcgaccgtggtcagctggtgccgatcgcgattcaactgaacccggcggttggccgtcagagccaactgattaccccgttcgacgatccgctgacctggtttcacgcgaaactgtgcgttcagatcgcggacgcgaaccaccacgagatgagcagccacctgtgccgtacccacttcgtgatggaaccgtttgcgattgttaccgcgcgtcaactggcggataaccacccgctgaacctgctgctgaaaccgcacttccgttttatgctggcgaacaacgacctgggtcgtaagcgtctggtgaaccgtggtggcccggttgatgagctgctggcgggcaccctgcaggaaagcctgcaaattgtggttaacgcgtacaaagagtggagcctggatgaattcgcgctgccgaccgaaatcaagaaccgtggtatggacgataagctgaaactgccgcactacccgtatcgtgacgatggcatgctgctgtggaacgcgattaagaaatttgtgagcgagtacctgaagctgtactataaaaccccgcaggacctgaccgcggatctggaactgcaggcgtgggcgcaagagctggttagcgaaagcggtggccgtgtgaaaggtgttccgagccgtatcgagaagctggaacaactggtggacatcgcgaccgcggttatttttacctgcggtccgcagcatgcggcggtgaactacagccaatacgagtatatgacctttatgccgaacatgccgctggcggcgtataagcagatgaccgcggaaggcaccatcgcggatcgtaaaagcctgctgagcttcctgccgccgagcaagcagaccgcggaccaactgagcatcctgtttattctgagcgcgtaccgttatgatcgtctgggttactatgacgataaattcgcggacccggaggcgcaagatattctggtgacctttcagcaagacctgaacgaggttgagcgtaagatcgaactgaacaacaagagccgtctgattaaatacaactatctgaagccgcgtctggtgaccaacagcatcagcgtttaa

SEQ ID NO: 40 - protein, 547 aa, Nostoc calcicola
MKPYLPQNDPDPIKRKYSLEHKKEEYEFDHDFLSPMAMLKDVPAVENFSTRYIAERTVETAELPINMLAVKTRALWDPLDELQDYEDYFPVLPKPNVIKTYQTDDSFCEQRLCGANPMALQQIKEMPLGFEFTIEELQEKFGESINLVEKLADGNLYVTDYRPLSFVKGGTYERGKKYLPTPLAFFCWRSSGFSDRGQLVPIAIQLNPAVGRQSQLITPFDDPLTWFHAKLCVQIADANHHEMSSHLCRTHFVMEPFAIVTARQLADNHPLNLLLKPHFRFMLANNDLGRKRLVNRGGPVDELLAGTLQESLQIVVNAYKEWSLDEFALPTEIKNRGMDDKLKLPHYPYRDDGMLLWNAIKKFVSEYLKLYYKTPQDLTADLELQAWAQELVSESGGRVKGVPSRIEKLEQLVDIATAVIFTCGPQHAAVNYSQYEYMTFMPNMPLAAYKQMTAEGTIADRKSLLSFLPPSKQTADQLSILFILSAYRYDRLGYYDDKFADPEAQDILVTFQQDLNEVERKIELNNKSRLIKYNYLKPRLVTNSISV

SEQ ID NO: 41 - DNA, 1644 bp, Artificial Sequence
  Codon-optimized coding sequence for WP_096647440.1
atgaaaccgtacctgccgcagaacgacccggagccgacccagcgtaagaacttcctggaacgtaaacagggcgagtatgaattcgatcacaagtttctgaaaccgatggcgatgctgaagaacgtgccgagcattgagaactttagcaccaaatacatcgcggaacgtaccgtggagaccgcggaactgccgctgaacatgctggcggttaaaacccgtagcctgtgggacccgctggatgagctgcaggactacgaagattatttcccggtgctgccgaagccgaacgttatcaaaacctaccagaccgacaacagcttttgcgagcaacgtctgtgcggtgcgaacccgctggttctgcgtcagattcagcaaatgccggatggcttcgcgtttaccatcagcgagctgcaagaaaagttcggtgacagcattgatctggaggaacgtctgaaaaccggcaacctgtacgtggcggactatcgtgcgctggcgtttgttaagggtggcacctacgagcgtggtaagaaatatctgccgaccccgatcgcgttcttttgctggcgtagcagcggtttcagcgatcgtggccagctggtgccgatcgcgattcaaatcaacccgaccgacggcaagcagagccaactgatcaccccgttcgatgaaccgctggtgtggtttcacgcgaaactgtgcgttcagattgcggacgcgaaccaccacgagatgagcagccacctgtgccgtacccacttcgtgatggaaccgtttgcgattgttaccgcgcgtcagctggcggataaccacccgctgaacctgctgctgaagccgcacttccgttttatgctggcgaacaacgagctgggtcgtcaacgtctggtgaaccgtggtggcccggttgatgagctgctggcgggcaccctgcaggaaagcctgcaaatcgtggttaacgcgtacaaagagtggagcctggatcagttcagcctgccgaccgaactgaagaaccgtggtatggacaacagcgataaactgccgcactacccgtatcgtgacgatggcctgctgctgtggaacgcgattaagaaattcgtgagcgaatatctgaagctgtactataaaaccccgcaagacctgaccgcggattttgagctgcagagctgggcgcaagaactggttagccagagcggtggccgtgtgaaaggtgttagcgaccgtatcaccaccctggaccaactgattgatatcgcgaccgcggtgatttttacctgcggtccgcagcatgcggcggttaactacagccaatacgagtatatgacctttatcccgaacatgccgctggcggcgtataagcagattaccagcgagggtaacatcccggaccgtaagagcctgctgagcttcctgccgccgagcaaacagaccgcggatcaactgagcattctgtttatcctgagcgcgtaccgttatgaccgtctgggctactatgacgataaattcctggatccggaggcgcaggaaatcctggttacctttcagcaagagctgaacgaggcggaacgtcaaattgaactgaacaacaagagccgtctgatcaactacgactatctgaaaccgcgtctggtgaccaacagcattagcgtttaa

SEQ ID NO: 42 - protein, 547 aa, Calothrix brevissima
MKPYLPQNDPEPTQRKNFLERKQGEYEFDHKFLKPMAMLKNVPSIENFSTKYIAERTVETAELPLNMLAVKTRSLWDPLDELQDYEDYFPVLPKPNVIKTYQTDNSFCEQRLCGANPLVLRQIQQMPDGFAFTISELQEKFGDSIDLEERLKTGNLYVADYRALAFVKGGTYERGKKYLPTPIAFFCWRSSGFSDRGQLVPIAIQINPTDGKQSQLITPFDEPLVWFHAKLCVQIADANHHEMSSHLCRTHFVMEPFAIVTARQLADNHPLNLLLKPHFRFMLANNELGRQRLVNRGGPVDELLAGTLQESLQIVVNAYKEWSLDQFSLPTELKNRGMDNSDKLPHYPYRDDGLLLWNAIKKFVSEYLKLYYKTPQDLTADFELQSWAQELVSQSGGRVKGVSDRITTLDQLIDIATAVIFTCGPQHAAVNYSQYEYMTFIPNMPLAAYKQITSEGNIPDRKSLLSFLPPSKQTADQLSILFILSAYRYDRLGYYDDKFLDPEAQEILVTFQQELNEAERQIELNNKSRLINYDYLKPRLVTNSISV

SEQ ID NO: 43 - DNA, 1641 bp, Artificial Sequence
  Codon-optimized coding sequence for WP_099099431.1
atgaaaccgtacctgccgcagaaagacccggatgttaaagtgcgtatcaactggctggacaaaaaccgtgaggaatataagttcaactacgactatctggcgccgctgccggttatcgataaagtgccgcacaaggagatttttagcgcggaatacaccaccaaacgtctggcgagcatggcgagcctggcgccgaacatgctggcggcgaaggcgcgtaacttcctggacccgctggatgagctggaggaatacgaggaactgctgagcctgctgccgaagccggacgttatcaagaactataaaaccgatagctgctttgcggaacaacgtctgagcggtgcgaacccgctggcgatccaaaaaattgacgttctgccggataacttcgcggtgaccgatgcgcactttcagaaggtggcgggcaccgagttcaccctggaaaaggcgctgaaagagggcaagctgtactttctggactatccgctgctgagcgatatcaaaggtggcgtttacaacaacgtgaagaaatatctgccgaagccgcaggcgctgttctactggcaaagcaacgacagcccgaacggtggcagcctggttccggtggcgatccagattaaccacgatagcggtggcaaaagcgttatctataccccggacgatccgcacctggactggtttctggcgaagacctgcgtgcagattgcggatggtaaccaccaagagctgggcagccacttcgcgtacacccacgcggttatggcgccgtttgcgatcgtgaccgcgcgtcaactggcggaaaaccacccgattgcgctgctgctgaaaccgcacttccgttttatgctgttcgacaacgatctgggtcgtacccagtttctgcaaccgggtggcccggttgacgagttcatggcgggtagcctggcggaaagcctgggctttgttgcgaaggtgtacgaggaatggagcgtggagaaattcacctttccgcgtctgatcaagagccgtcgtaccgacgatccggaaattctgccgcacttcccgtttcgtgacgatggtatgctgatctggaacgcggttgagaaattcgtgtacgaatatctgcagctgtactataagaccagccaagacctgattgacgattatgagctgcagaactgggcgcgtgaactggttgcgcaagatggtggccgtgtgaaaggcatgccggcgaagatcgagaccctggaacagctgattgagatcattagcgtggttgtttttacctgcgcgccgctgcacagcgcgctgaacttcagccaatacgaatatatggcgtttgttccgaacatgccgtacgcggcgtatcacccgatcccggagaccaaaggtgtggacctggaaaccatcatgaaaattctgccgccgttcaagcaggcggcggaccaagttatgtggaccgagattctgaccagctaccactatgataagctgggcttctacgacgaggaatttgcggatccgctggcgcaggaaatcgttgtgcaattccagcaaaacctgcacgagattgaacgtcagatcgatattcgtaaccaaacccgtccgatcccgtacaactattttaaaccgagccagatcattaacagcattaacacctaa

SEQ ID NO: 44 - protein, 546 aa, Nostoc sp. DB3992
MKPYLPQKDPDVKVRINWLDKNREEYKFNYDYLAPLPVIDKVPHKEIFSAEYTTKRLASMASLAPNMLAAKARNFLDPLDELEEYEELLSLLPKPDVIKNYKTDSCFAEQRLSGANPLAIQKIDVLPDNFAVTDAHFQKVAGTEFTLEKALKEGKLYFLDYPLLSDIKGGVYNNVKKYLPKPQALFYWQSNDSPNGGSLVPVAIQINHDSGGKSVIYTPDDPHLDWFLAKTCVQIADGNHQELGSHFAYTHAVMAPFAIVTARQLAENHPIALLLKPHFRFMLFDNDLGRTQFLQPGGPVDEFMAGSLAESLGFVAKVYEEWSVEKFTFPRLIKSRRTDDPEILPHFPFRDDGMLIWNAVEKFVYEYLQLYYKTSQDLIDDYELQNWARELVAQDGGRVKGMPAKIETLEQLIEIISVVVFTCAPLHSALNFSQYEYMAFVPNMPYAAYHPIPETKGVDLETIMKILPPFKQAADQVMWTEILTSYHYDKLGFYDEEFADPLAQEIVVQFQQNLHEIERQIDIRNQTRPIPYNYFKPSQIINSINT

SEQ ID NO: 45 - DNA, 1632 bp, Artificial Sequence
  Codon-optimized coding sequence for WP_052672367.1
atgaaaccgtacctgccgcaacatgagccggatgcgattgcgcgtcagaaccgtctgattaaaaaccgtgcggactatgtgctggattacaactatctgccgccgatcccgctgcagaccccggttccgcagcaagagcgtttcagcgcggaatacaccgcgcgtcgtctggcgagctttgcgaacctggtgccgaacatgctgatggcgcgtgcgcgtaacgcgtttgacccgctggataccctggaggaatatgcggacctgctgccggtgctgccgaagccgaacgttattaaaaactatcaagcggattggtgcttcgcggagcagcgtctgagcggtatcaacccgccggcgatccgtcgtattgacgcgctgccggaaaacctgccgattagcaacagcagctttcaacacagcgttggcgcggagcacaacctggaacaggcgctgaaggaaggtaaactgtactgcctggactatccgctgctgagcggcatcggtggcggtaactaccaaaacctgccgaagtatctgccgaaaccgcaggcgctgttttactggcgtagcgataacagcaagattggcggtagcctggtgccggttgcgatcaagattctgaacgagctgggcggtaaaaacctggtgtacaccccgaacgacgcgccgctggattggttcctggcgaagacctgcgttcagatggcggacgcgaaccaccaagaactgggcacccactttgcgaaaacccatgcggttatggcgccgattgcggcgattaccgcgcgtgagctgggtgaaaaccacccgctgaccctgctgctgaaaccgcacttccgttttatgctgttcgataacgagctgggtcgtacccagtttctgcaaccgaccggtccgaccgaggaactgctggcgggcaccctggaggaaagcgttcagctggttgtgcaagcgtacgaggaatggagcatcgacaccaccttcccgctggagctgcagcaacgtcaaatgcacgatccggaaattctgccgcactatccgttccgtgacgatggcatcctggtgtggaacgcgattcaccagtttgttaccgaatacctgcaaatttactatcacaccccgcaggacatcagcgcggattatgaggtgcagaactgggcgcgtgaactggtggacagcggtcgtgttaagggtatgccggagagcatcgacaccctggcgcaactgattgatatcattgcggtggttatcttcacctgcgcgccgctgcacagctgcctgaacctggcgcagtacgaatatatgacctttgttccgaacatgccgtacgcggcgtatcacccgatcccgaccaccaagggtgtggatatggcgaccatcgttaaaattatgccgccattccagcgtgcgatcgaccaaattctgtggaccgatatcctgagcgcgtttcaatacgacaagctgggcttctatgaggaagactttgcggatccgaaagcgcaggaagtgctgcagcgtttccaagataacctgcagcaagttgaggaaaagatcgaaatgcacaaccagatccgtccgattccgtacaactatctgaaaccgagccgtatcatgaacagcattaacacctaa

SEQ ID NO: 46 - protein, 543 aa, Aliterella atlantica
MKPYLPQHEPDAIARQNRLIKNRADYVLDYNYLPPIPLQTPVPQQERFSAEYTARRLASFANLVPNMLMARARNAFDPLDTLEEYADLLPVLPKPNVIKNYQADWCFAEQRLSGINPPAIRRIDALPENLPISNSSFQHSVGAEHNLEQALKEGKLYCLDYPLLSGIGGGNYQNLPKYLPKPQALFYWRSDNSKIGGSLVPVAIKILNELGGKNLVYTPNDAPLDWFLAKTCVQMADANHQELGTHFAKTHAVMAPIAAITARELGENHPLTLLLKPHFRFMLFDNELGRTQFLQPTGPTEELLAGTLEESVQLVVQAYEEWSIDTTFPLELQQRQMHDPEILPHYPFRDDGILVWNAIHQFVTEYLQIYYHTPQDISADYEVQNWARELVDSGRVKGMPESIDTLAQLIDIIAVVIFTCAPLHSCLNLAQYEYMTFVPNMPYAAYHPIPTTKGVDMATIVKIMPPFQRAIDQILWTDILSAFQYDKLGFYEEDFADPKAQEVLQRFQDNLQQVEEKIEMHNQIRPIPYNYLKPSRIMNSINT

SEQ ID NO: 47 - DNA, 1641 bp, Artificial Sequence
  Codon-optimized coding sequence for WP_073631249.1
atgaaaccgtacctgccgcagcatgacccgaacccggaagcgcgtcgtaactggctggaacaaaaccgtgaggactacaagtttgatcacaactatctggcgccgatcccgattctggacaaggttccgcacaaagagctgttcagcccgcagtataccgcgaaacgtctggcgagcatggcggatctggtgccgaacatgctggcggcgaaggcgcgtaacttctttgacccgctggatgaactggaggaatacgaggcgctgctgagcattctgccgaaaccgagcgttatcaagaactataaaaccgacagctgctttgcggaacagcgtctgagcggtgcgaacccgatggcgatgcaccgtattgacgagctgccggaaaagttcccggttaccaacgatcactttcaaaaagcggtgggtgcggaacacaacctggaggcggcgctgaaagagggtaaactgtacctgctggactatccgctgctgtttgatattaagggtggcacctaccagaacatcaagaaatatctgccgaaaccgcaggcgctgttctactggcaaagcaacggtaacaagaacagcggcagcctggttccgatcgcgattcaaatccacaacgacaccggtggcgatagcctgatttataccccggacgatccgcacctggactggttcctggcgaagacctgcgtgcagatcgcggatgcgaaccaccaagaactgggtagccacttcgcgcgtacccacgcggttatggcgccgtttgcgattgtgaccgcgcgtcaactgggtgaaaaccacccgctggcgctgctgctgaaaccgcacttccgttttatgctgtacgacaacgatctgggtcgtacccacttcctgcaggcgggtggcccggttgacgaatttatggcgggcaccctgcaagagagcctgggctttgtggcgaaggcgtacgaggaatggagcctggataacgcggttttcccgaccgaagtgaagaaccgtaaaatggacgatccggacattctgccgcactatccgtttcgtgacgatggtatgctgctgtgggatgcggttaagaaattcgtgaccgaatacctgcagctgtactataaaaccccgcaagacctgagcgaggattatgaactgcaaaactgggcgcgtgagctggcggcgcaagacggtggctgcgttaagggcatgccggagaaaattgaaaccatcgagcagctgatccacgtggttaccgtggttgtgtttacctgcgcgccgctgcacagcgcgctgaacttcagccaatacgaatatatggcgtttgttccgaacatgccgtacgcggcgtactatccggttccggagaccaaaggtgtggatatgcagaccattatgaagatgctgccgccgttcaaacaggcggcggaccaagtgatgtggagcgatatcctgaccagcttccactacgacaagctgggccactatgatgaggaatttgcgaacccgatggcgcaggcgatcctgctgcaattccagcaaaacctgcacgaggtggaacgtcagattgaaatcaagaaccaaagccgtccgattccgtacaactatctgaaaccgagcgagatcattaacagcatcaacacctaa

SEQ ID NO: 48 - protein, 546 aa, Scytonema sp. HK-05
MKPYLPQHDPNPEARRNWLEQNREDYKFDHNYLAPIPILDKVPHKELFSPQYTAKRLASMADLVPNMLAAKARNFFDPLDELEEYEALLSILPKPSVIKNYKTDSCFAEQRLSGANPMAMHRIDELPEKFPVTNDHFQKAVGAEHNLEAALKEGKLYLLDYPLLFDIKGGTYQNIKKYLPKPQALFYWQSNGNKNSGSLVPIAIQIHNDTGGDSLIYTPDDPHLDWFLAKTCVQIADANHQELGSHFARTHAVMAPFAIVTARQLGENHPLALLLKPHFRFMLYDNDLGRTHFLQAGGPVDEFMAGTLQESLGFVAKAYEEWSLDNAVFPTEVKNRKMDDPDILPHYPFRDDGMLLWDAVKKFVTEYLQLYYKTPQDLSEDYELQNWARELAAQDGGCVKGMPEKIETIEQLIHVVTVVVFTCAPLHSALNFSQYEYMAFVPNMPYAAYYPVPETKGVDMQTIMKMLPPFKQAADQVMWSDILTSFHYDKLGHYDEEFANPMAQAILLQFQQNLHEVERQIEIKNQSRPIPYNYLKPSEIINSINT

SEQ ID NO: 49 - DNA, 1620 bp, Artificial Sequence
  Codon-optimized coding sequence for WP_013220336.1
atgaacaccagcctgccgcagaacgacagcgatccgcaaggtcgtaaggaccgtctggaacgtcgtcgtgcgctgtacgtgttcaactacgactatgttccgccgatcccgatgattgataaggttccgcacgaggaatactttagcccgaaatataccgcggagcgtctggcgagcatggcgaaactggcgccgaacatgctggcggcgaagaccaaacgtctgttcgatccgctggacgagctgaacgaatacgacgagatgttcatctttctggataagccgggtattgttcgtggctatcgtaccgatgaaagcttcggcgagcagcgtctgagcggcgtgaacccgatgagcatccgtcgtctggataaactgccggaagactttccgattatggatgaatacctggagcagagcctgggtagcccgcacaccctggcgcaggcgctgcaagaaggccgtctgtatttcctggagtttccgcaactggcgcacgttaaagagggtggtctgtaccgtggtcgtaagaaatatctgccgaaaccgcgtgcgctgttctgctgggacggtaaccacctgcagccggtggcgatccagattagcggccaaccgggtggccgtctgttcattccgcgtgacagcgatctggactggtttgtggcgaagctgtgcgttcagatcgcggatgcgaaccaccaagaactgggcacccacttcgcgcgtacccacgtggttatggcgccgtttgcggtggttacccatcgtcagctggcggagaaccacccgctgcacattctgctgcgtccgcacttccgttttatgctgtacgataacgacctgggtcgtacccgttttatccagccggacggcccggttgaacacatgatggcgggcaccctggaggaaagcatcggcattagcgcggcgttctacaaggaatggcgtctggatgaggcggcgtttccgatcgagattgcgcgtcgtaaaatggacgatccggaagtgctgccgcactacccgttccgtgacgatggtatgctgctgtgggacggcattcagaagtttgttaaagagtatctggcgctgtactatcaaagcccggaagatctggtgcaggaccaagagctgcgtaactgggcgcgtgaactgaccgcgaacgatggtggccgtgtggcgggtatgccgggtcgtatcgaaaccgttgatcagctgaccagcatcctgagcaccgtgatttatacctgcgcgccgctgcacagcgcgctgaacttcgcgcaatacgagtatatcggttatgttccgaacatgccgtacgcggcgtatcacccgattccggaggaaggtggcgtggacatggagaccctgatgaagattctgccgccgtacgaacaggcggcgctgcaactgaaatggaccgagatcctgaccagctaccactatgatcgtctgggccactatgacgaaaagttcgaggatccgcaggcgcaagcggtggttgaacagtttcagcaagagctggcggcggtggagcaagaaattgaccagcgtaaccaagatcgtccgctggcgtacacctatctgaaaccgagcgaaatcattaacagcatcaacacctaa

SEQ ID NO: 50 - protein, 539 aa, Nitrosococcus watsonii
MNTSLPQNDSDPQGRKDRLERRRALYVFNYDYVPPIPMIDKVPHEEYFSPKYTAERLASMAKLAPNMLAAKTKRLFDPLDELNEYDEMFIFLDKPGIVRGYRTDESFGEQRLSGVNPMSIRRLDKLPEDFPIMDEYLEQSLGSPHTLAQALQEGRLYFLEFPQLAHVKEGGLYRGRKKYLPKPRALFCWDGNHLQPVAIQISGQPGGRLFIPRDSDLDWFVAKLCVQIADANHQELGTHFARTHVVMAPFAVVTHRQLAENHPLHILLRPHFRFMLYDNDLGRTRFIQPDGPVEHMMAGTLEESIGISAAFYKEWRLDEAAFPIEIARRKMDDPEVLPHYPFRDDGMLLWDGIQKFVKEYLALYYQSPEDLVQDQELRNWARELTANDGGRVAGMPGRIETVDQLTSILSTVIYTCAPLHSALNFAQYEYIGYVPNMPYAAYHPIPEEGGVDMETLMKILPPYEQAALQLKWTEILTSYHYDRLGHYDEKFEDPQAQAVVEQFQQELAAVEQEIDQRNQDRPLAYTYLKPSEIINSINT

SEQ ID NO: 51 - protein, 914 aa, Artificial Sequence
  Consensus sequence of CoLox
  MISC_FEATURE (2)..(2): Xaa can be any naturally occurring amino acid
  MISC_FEATURE (4)..(4): Xaa can be any naturally occurring amino acid
  MISC_FEATURE (19)..(19): Xaa can be any naturally occurring amino acid
  MISC_FEATURE (24)..(24): Xaa can be any naturally occurring amino acid
  MISC_FEATURE (99)..(99): Xaa can be any naturally occurring amino acid
  MISC_FEATURE (151)..(151): Xaa can be any naturally occurring amino acid
  MISC_FEATURE (230)..(230): Xaa can be any naturally occurring amino acid
  MISC_FEATURE (279)..(279): Xaa can be any naturally occurring amino acid
  MISC_FEATURE (285)..(285): Xaa can be any naturally occurring amino acid
  MISC_FEATURE (289)..(289): Xaa can be any naturally occurring amino acid
  MISC_FEATURE (335)..(335): Xaa can be any naturally occurring amino acid
  MISC_FEATURE (495)..(495): Xaa can be any naturally occurring amino acid
  MISC_FEATURE (523)..(523): Xaa can be any naturally occurring amino acid
  MISC_FEATURE (625)..(625): Xaa can be any naturally occurring amino acid
  MISC_FEATURE (703)..(703): Xaa can be any naturally occurring amino acid
  MISC_FEATURE (726)..(726): Xaa can be any naturally occurring amino acid
  MISC_FEATURE (736)..(736): Xaa can be any naturally occurring amino acid
  MISC_FEATURE (820)..(820): Xaa can be any naturally occurring amino acid
MXSXPTVRSMVMLAVLAVXALESXPCASAFATLPRALVRPQAALKYRAEDKNDVDVAPAGSTASDVSKPEGKATAVAKGTVNAPIEEAWKVFRSFSNMXQWMPVYGEWEATGDSVGDTRTFNFKDQPTFFTTERLVGLDDSQYKMKYTLVXCKGSPVPIESIDTIVTFTANDDVTEVDWRSWTKSPMVDLIKGRQAAGYAGGIAALDRYLNPSLGTVDVTIKSADNLDGXFLSSSYATLMVTDADPEQVHAKEWGTSPEFDAKPVQFSLLKPDSKLYMXVMLTKXGVDXPVGYAVFDIQKSLKSGETVTETFQLEGSNDATLTVEMELNLRQGSXLPQSKAQKNLATLVALQQSVERVRDRIVTIGKLAGEPEKSVWEYERKSGLPKSVKGLPRSEVLPPHKIALMVDAIAEYAYTQFQLVQRLLPVRNSYDRYAAYFAPEGEEYVPIPQILKDMTWSTDDEFIRQIFAGLNPLQVEVVKNKAGLPSKLQELKAXDGSDVDKLISEGRLYVLDYSVLKDLDLXRNGVTLYAPTMLIYRTGGDKLDVLGIMLEPRRDDAPVYTPDSETPNKFLLAKCHVACADNQVHQFTYHLGYAHLATEPLAIASHNVLEKNSHPLGMFLKPHXRDNIGINYLARQTLVADEDAITDHTFATGTAQGVSMVVDAFKSYNFLESGLPDELRRRGFERSDDLKVYRYRDDGWLXWDTLWKYAEDMVNELYGTDNDVXADKVVQEWAXEASGSDTADVQGFPESITTKYILTKVLTTIIWQASALHSALNYIQYPYTATPINRAASIFGPVPDGEADITEQDILDVIPGGLXDENNRGLTLSIFQGLLSWLLRTPENPTLDEVGSPIPNRNNPIEWVEFRSKYPQVYYNLDQNLAVVEKIIEERNKGLASPYEVLLPSHIAASINI

SEQ ID NO: 52 - protein, 653 aa, Artificial Sequence
  Consensus sequence for the protein sequences of bacterial LOX
  MISC_FEATURE (1)..(10): Xaa can be any naturally occurring amino acid
  MISC_FEATURE (14)..(20): Xaa can be any naturally occurring amino acid
  MISC_FEATURE (22)..(24): Xaa can be any naturally occurring amino acid
  MISC_FEATURE (26)..(31): Xaa can be any naturally occurring amino acid
  MISC_FEATURE (33)..(40): Xaa can be any naturally occurring amino acid
  MISC_FEATURE (42)..(48): Xaa can be any naturally occurring amino acid
  MISC_FEATURE (50)..(51): Xaa can be any naturally occurring amino acid
  MISC_FEATURE (53)..(53): Xaa can be any naturally occurring amino acid
  MISC_FEATURE (56)..(57): Xaa can be any naturally occurring amino acid
  MISC_FEATURE (59)..(61): Xaa can be any naturally occurring amino acid
  MISC_FEATURE (63)..(69): Xaa can be any naturally occurring amino acid
  MISC_FEATURE (71)..(72): Xaa can be any naturally occurring amino acid
  MISC_FEATURE (74)..(83): Xaa can be any naturally occurring amino acid
  MISC_FEATURE (86)..(86): Xaa can be any naturally occurring amino acid
  MISC_FEATURE (88)..(91): Xaa can be any naturally occurring amino acid
  MISC_FEATURE (93)..(101): Xaa can be any naturally occurring amino acid
  MISC_FEATURE (103)..(107): Xaa can be any naturally occurring amino acid
  MISC_FEATURE (109)..(113): Xaa can be any naturally occurring amino acid
  MISC_FEATURE (115)..(115): Xaa can be any naturally occurring amino acid
  MISC_FEATURE (120)..(120): Xaa can be any naturally occurring amino acid
  MISC_FEATURE (122)..(122): Xaa can be any naturally occurring amino acid
  MISC_FEATURE (125)..(159): Xaa can be any naturally occurring amino acid
  MISC_FEATURE (161)..(165): Xaa can be any naturally occurring amino acid
  MISC_FEATURE (167)..(185): Xaa can be any naturally occurring amino acid
  MISC_FEATURE (188)..(193): Xaa can be any naturally occurring amino acid
  MISC_FEATURE (195)..(195): Xaa can be any naturally occurring amino acid
  MISC_FEATURE (198)..(198): Xaa can be any naturally occurring amino acid
  MISC_FEATURE (200)..(200): Xaa can be any naturally occurring amino acid
  MISC_FEATURE (202)..(202): Xaa can be any naturally occurring amino acid
  MISC_FEATURE (204)..(204): Xaa can be any naturally occurring amino acid
  MISC_FEATURE (206)..(217): Xaa can be any naturally occurring amino acid
  MISC_FEATURE (219)..(220): Xaa can be any naturally occurring amino acid
  MISC_FEATURE (222)..(241): Xaa can be any naturally occurring amino acid
  MISC_FEATURE (243)..(249): Xaa can be any naturally occurring amino acid
  MISC_FEATURE (251)..(252): Xaa can be any naturally occurring amino acid
  MISC_FEATURE (255)..(255): Xaa can be any naturally occurring amino acid
  MISC_FEATURE (257)..(257): Xaa can be any naturally occurring amino acid
  MISC_FEATURE (259)..(259): Xaa can be any naturally occurring amino acid
  MISC_FEATURE (262)..(262): Xaa can be any naturally occurring amino acid
  MISC_FEATURE (265)..(265): Xaa can be any naturally occurring amino acid
  MISC_FEATURE (267)..(269): Xaa can be any naturally occurring amino acid
  MISC_FEATURE (271)..(273): Xaa can be any naturally occurring amino acid
  MISC_FEATURE (276)..(276): Xaa can be any naturally occurring amino acid
  MISC_FEATURE (279)..(279): Xaa can be any naturally occurring amino acid
  MISC_FEATURE (281)..(281): Xaa can be any naturally occurring amino acid
  MISC_FEATURE (283)..(284): Xaa can be any naturally occurring amino acid
  MISC_FEATURE (286)..(288): Xaa can be any naturally occurring amino acid
  MISC_FEATURE (290)..(291): Xaa can be any naturally occurring amino acid
  MISC_FEATURE (295)..(297): Xaa can be any naturally occurring amino acid
  MISC_FEATURE (300)..(300): Xaa can be any naturally occurring amino acid
  MISC_FEATURE (303)..(304): Xaa can be any naturally occurring amino acid
  MISC_FEATURE (308)..(309): Xaa can be any naturally occurring amino acid
  MISC_FEATURE (311)..(311): Xaa can be any naturally occurring amino acid
  MISC_FEATURE (313)..(321): Xaa can be any naturally occurring amino acid
  MISC_FEATURE (323)..(329): Xaa can be any naturally occurring amino acid
  MISC_FEATURE (331)..(331): Xaa can be any naturally occurring amino acid
  MISC_FEATURE (333)..(333): Xaa can be any naturally occurring amino acid
  MISC_FEATURE (335)..(350): Xaa can be any naturally occurring amino acid
  MISC_FEATURE (352)..(358): Xaa can be any naturally occurring amino acid
  MISC_FEATURE (360)..(364): Xaa can be any naturally occurring amino acid
  MISC_FEATURE (366)..(372): Xaa can be any naturally occurring amino acid
  MISC_FEATURE (376)..(376): Xaa can be any naturally occurring amino acid
  MISC_FEATURE (378)..(378): Xaa can be any naturally occurring amino acid
  MISC_FEATURE (383)..(383): Xaa can be any naturally occurring amino acid
  MISC_FEATURE (385)..(385): Xaa can be any naturally occurring amino acid
  MISC_FEATURE (387)..(391): Xaa can be any naturally occurring amino acid
  MISC_FEATURE (394)..(395): Xaa can be any naturally occurring amino acid
  MISC_FEATURE (397)..(400): Xaa can be any naturally occurring amino acid
  MISC_FEATURE (402)..(409): Xaa can be any naturally occurring amino acid
  MISC_FEATURE (411)..(411): Xaa can be any naturally occurring amino acid
  MISC_FEATURE (413)..(415): Xaa can be any naturally occurring amino acid
  MISC_FEATURE (417)..(418): Xaa can be any naturally occurring amino acid
  MISC_FEATURE (421)..(429): Xaa can be any naturally occurring amino acid
  MISC_FEATURE (431)..(431): Xaa can be any naturally occurring amino acid
  MISC_FEATURE (433)..(433): Xaa can be any naturally occurring amino acid
  MISC_FEATURE (435)..(444): Xaa can be any naturally occurring amino acid
  MISC_FEATURE (446)..(455): Xaa can be any naturally occurring amino acid
  MISC_FEATURE (457)..(457): Xaa can be any naturally occurring amino acid
  MISC_FEATURE (459)..(459): Xaa can be any naturally occurring amino acid
  MISC_FEATURE (461)..(463): Xaa can be any naturally occurring amino acid
  MISC_FEATURE (465)..(466): Xaa can be any naturally occurring amino acid
  MISC_FEATURE (468)..(469): Xaa can be any naturally occurring amino acid
  MISC_FEATURE (471)..(475): Xaa can be any naturally occurring amino acid
  MISC_FEATURE (479)..(479): Xaa can be any naturally occurring amino acid
  MISC_FEATURE (481)..(481): Xaa can be any naturally occurring amino acid
  MISC_FEATURE (483)..(560): Xaa can be any naturally occurring amino acid
  MISC_FEATURE (562)..(568): Xaa can be any naturally occurring amino acid
  MISC_FEATURE (570)..(575): Xaa can be any naturally occurring amino acid
  MISC_FEATURE (577)..(580): Xaa can be any naturally occurring amino acid
  MISC_FEATURE (583)..(583): Xaa can be any naturally occurring amino acid
  MISC_FEATURE (586)..(586): Xaa can be any naturally occurring amino acid
  MISC_FEATURE (588)..(598): Xaa can be any naturally occurring amino acid
  MISC_FEATURE (600)..(617): Xaa can be any naturally occurring amino acid
  MISC_FEATURE (620)..(621): Xaa can be any naturally occurring amino acid
  MISC_FEATURE (623)..(628): Xaa can be any naturally occurring amino acid
  MISC_FEATURE (630)..(632): Xaa can be any naturally occurring amino acid
  MISC_FEATURE (634)..(635): Xaa can be any naturally occurring amino acid
  MISC_FEATURE (637)..(639): Xaa can be any naturally occurring amino acid
  MISC_FEATURE (641)..(644): Xaa can be any naturally occurring amino acid
  MISC_FEATURE (646)..(649): Xaa can be any naturally occurring amino acid
  MISC_FEATURE (653)..(654): Xaa can be any naturally occurring amino acid
XXXXXXXXXXLPQXXXXXXXRXXXLXXXXXXYXXXXXXXXPXXXXXXXPXXEXFSXXYXXXRXXXXXXXLXXNXXXXXXXXXXDPXDXXXXYXXXXXXXXXPXXXXXYXXXXXFXEQRLXGXNPXXXXXXXXXXXXXXXXXXXXXXXXXXXXXXXXXXXLXXXXXYXXXXXXXXXXXXXXXXXXXGGXXXXXXKXLPXPXAXFXWXXXXXXXXXXXXPXXIXXXXXXXXXXXXXXXXXXXXPXXXXXXXWXXAKXCXQXADXNHXEXXXHXXXTHXVMXPXAXXTXXXLXXNHPXXXLLXPHXXFMLXXNXLXXXXXXXXXGXXXXXXXGXLXEXXXXXXXXXXXXXXXXWXXXXXXXPXXXXXRXXXXXXXLPHXPXRDDGXLXWXXXXXFVXXYXXXXYXXXXXXXXDXEXXXWXXELXXXXXXXXXGXVXGXXXXXXXXXXLXXXXXXXXXXCXPXHXXXNXXQXXYXXXXXNMPXAXYXXXXXXXXXXXXXXXXXXXXXXXXXXXXXXXXXXXXXXXXXXXXXXXXXXXXXXXXXXXXXXXXXXXXXXXXXXXXXXPXXXXXXXQXXXXXXLXXXXYDXLGXYXXXXXXXXXXXFXXXXXXXXXXXXXXXXXXFQXXLXXXXXXIXXXNXXRXXXYXXXXPXXXXNSIX

SEQ ID NO: 53 - protein, 659 aa, Artificial Sequence
  Consensus sequence for bacterial LOX and UfLOX2 protein sequences
  MISC_FEATURE (1)..(10): Xaa can be any naturally occurring amino acid
  MISC_FEATURE (13)..(20): Xaa can be any naturally occurring amino acid
  MISC_FEATURE (22)..(48): Xaa can be any naturally occurring amino acid
  MISC_FEATURE (50)..(55): Xaa can be any naturally occurring amino acid
  MISC_FEATURE (57)..(58): Xaa can be any naturally occurring amino acid
  MISC_FEATURE (60)..(62): Xaa can be any naturally occurring amino acid
  MISC_FEATURE (64)..(73): Xaa can be any naturally occurring amino acid
  MISC_FEATURE (75)..(84): Xaa can be any naturally occurring amino acid
  MISC_FEATURE (86)..(104): Xaa can be any naturally occurring amino acid
  MISC_FEATURE (106)..(117): Xaa can be any naturally occurring amino acid
  MISC_FEATURE (119)..(119): Xaa can be any naturally occurring amino acid
  MISC_FEATURE (124)..(124): Xaa can be any naturally occurring amino acid
  MISC_FEATURE (126)..(126): Xaa can be any naturally occurring amino acid
  MISC_FEATURE (129)..(163): Xaa can be any naturally occurring amino acid
  MISC_FEATURE (165)..(169): Xaa can be any naturally occurring amino acid
  MISC_FEATURE (171)..(189): Xaa can be any naturally occurring amino acid
  MISC_FEATURE (191)..(197): Xaa can be any naturally occurring amino acid
  MISC_FEATURE (199)..(199): Xaa can be any naturally occurring amino acid
  MISC_FEATURE (202)..(202): Xaa can be any naturally occurring amino acid
  MISC_FEATURE (204)..(206): Xaa can be any naturally occurring amino acid
  MISC_FEATURE (208)..(208): Xaa can be any naturally occurring amino acid
  MISC_FEATURE (210)..(222): Xaa can be any naturally occurring amino acid
  MISC_FEATURE (224)..(225): Xaa can be any naturally occurring amino acid
  MISC_FEATURE (227)..(246): Xaa can be any naturally occurring amino acid
  MISC_FEATURE (248)..(254): Xaa can be any naturally occurring amino acid
  MISC_FEATURE (256)..(257): Xaa can be any naturally occurring amino acid
  MISC_FEATURE (260)..(260): Xaa can be any naturally occurring amino acid
  MISC_FEATURE (262)..(262): Xaa can be any naturally occurring amino acid
  MISC_FEATURE (264)..(264): Xaa can be any naturally occurring amino acid
  MISC_FEATURE (267)..(268): Xaa can be any naturally occurring amino acid
  MISC_FEATURE (270)..(270): Xaa can be any naturally occurring amino acid
  MISC_FEATURE (272)..(274): Xaa can be any naturally occurring amino acid
  MISC_FEATURE (276)..(279): Xaa can be any naturally occurring amino acid
  MISC_FEATURE (281)..(282): Xaa can be any naturally occurring amino acid
  MISC_FEATURE (284)..(284): Xaa can be any naturally occurring amino acid
  MISC_FEATURE (286)..(286): Xaa can be any naturally occurring amino acid
  MISC_FEATURE (288)..(297): Xaa can be any naturally occurring amino acid
  MISC_FEATURE (300)..(302): Xaa can be any naturally occurring amino acid
  MISC_FEATURE (305)..(306): Xaa can be any naturally occurring amino acid
  MISC_FEATURE (308)..(309): Xaa can be any naturally occurring amino acid
  MISC_FEATURE (311)..(326): Xaa can be any naturally occurring amino acid
  MISC_FEATURE (328)..(334): Xaa can be any naturally occurring amino acid
  MISC_FEATURE (336)..(336): Xaa can be any naturally occurring amino acid
  MISC_FEATURE (338)..(338): Xaa can be any naturally occurring amino acid
  MISC_FEATURE (340)..(355): Xaa can be any naturally occurring amino acid
  MISC_FEATURE (357)..(369): Xaa can be any naturally occurring amino acid
  MISC_FEATURE (371)..(377): Xaa can be any naturally occurring amino acid
  MISC_FEATURE (381)..(381): Xaa can be any naturally occurring amino acid
  MISC_FEATURE (383)..(383): Xaa can be any naturally occurring amino acid
  MISC_FEATURE (388)..(388): Xaa can be any naturally occurring amino acid
  MISC_FEATURE (390)..(390): Xaa can be any naturally occurring amino acid
  MISC_FEATURE (392)..(397): Xaa can be any naturally occurring amino acid
  MISC_FEATURE (399)..(400): Xaa can be any naturally occurring amino acid
  MISC_FEATURE (402)..(405): Xaa can be any naturally occurring amino acid
  MISC_FEATURE (407)..(414): Xaa can be any naturally occurring amino acid
  MISC_FEATURE (416)..(416): Xaa can be any naturally occurring amino acid
  MISC_FEATURE (418)..(423): Xaa can be any naturally occurring amino acid
  MISC_FEATURE (425)..(434): Xaa can be any naturally occurring amino acid
  MISC_FEATURE (436)..(436): Xaa can be any naturally occurring amino acid
  MISC_FEATURE (438)..(438): Xaa can be any naturally occurring amino acid
  MISC_FEATURE (440)..(449): Xaa can be any naturally occurring amino acid
  MISC_FEATURE (451)..(460): Xaa can be any naturally occurring amino acid
  MISC_FEATURE (452)..(462): Xaa can be any naturally occurring amino acid
  MISC_FEATURE (464)..(464): Xaa can be any naturally occurring amino acid
  MISC_FEATURE (466)..(468): Xaa can be any naturally occurring amino acid
  MISC_FEATURE (470)..(471): Xaa can be any naturally occurring amino acid
  MISC_FEATURE (473)..(474): Xaa can be any naturally occurring amino acid
  misc_feature (476)..(476): Xaa can be any naturally occurring amino acid
  MISC_FEATURE (477)..(480): Xaa can be any naturally occurring amino acid
  MISC_FEATURE (484)..(484): Xaa can be any naturally occurring amino acid
  MISC_FEATURE (486)..(486): Xaa can be any naturally occurring amino acid
  MISC_FEATURE (488)..(565): Xaa can be any naturally occurring amino acid
  MISC_FEATURE (567)..(573): Xaa can be any naturally occurring amino acid
  MISC_FEATURE (575)..(580): Xaa can be any naturally occurring amino acid
  misc_feature (582)..(582): Xaa can be any naturally occurring amino acid
  MISC_FEATURE (583)..(586): Xaa can be any naturally occurring amino acid
  MISC_FEATURE (588)..(589): Xaa can be any naturally occurring amino acid
  MISC_FEATURE (591)..(591): Xaa can be any naturally occurring amino acid
  MISC_FEATURE (593)..(603): Xaa can be any naturally occurring amino acid
  MISC_FEATURE (605)..(623): Xaa can be any naturally occurring amino acid
  MISC_FEATURE (625)..(626): Xaa can be any naturally occurring amino acid
  MISC_FEATURE (628)..(633): Xaa can be any naturally occurring amino acid
  MISC_FEATURE (635)..(637): Xaa can be any naturally occurring amino acid
  MISC_FEATURE (639)..(640): Xaa can be any naturally occurring amino acid
  MISC_FEATURE (642)..(644): Xaa can be any naturally occurring amino acid
  MISC_FEATURE (646)..(654): Xaa can be any naturally occurring amino acid
  MISC_FEATURE (658)..(659): Xaa can be any naturally occurring amino acid
XXXXXXXXXXLPXXXXXXXXRXXXXXXXXXXXXXXXXXXXXXXXXXXXPXXXXXXSXXYXXXRXXXXXXXXXXNXXXXXXXXXXDXXXXXXXXXXXXXXXXXXXPXXXXXXXXXXXXFXEQRLXGXNPXXXXXXXXXXXXXXXXXXXXXXXXXXXXXXXXXXXLXXXXXYXXXXXXXXXXXXXXXXXXXGXXXXXXXKXLPXPXXXFXWXXXXXXXXXXXXXPXXIXXXXXXXXXXXXXXXXXXXXPXXXXXXXWXXAKXCXQXADXXHXEXXXHXXXXHXXMXPXAXXXXXXXXXXHPXXXLLXXHXXFXXXXXXXXXXXXXXXXGXXXXXXXGXLXEXXXXXXXXXXXXXXXXWXXXXXXXXXXXXXRXXXXXXXLPHXPXRDDGXLXWXXXXXXVXXYXXXXYXXXXXXXXDXEXXXXXXEXXXXXXXXXXGXVXGXXXXXXXXXXLXXXXXXXXXXCXPXHXXXNXXQXXYXXXXXNMPXAXYXXXXXXXXXXXXXXXXXXXXXXXXXXXXXXXXXXXXXXXXXXXXXXXXXXXXXXXXXXXXXXXXXXXXXXXXXXXXXXPXXXXXXXQXXXXXXLXXXXXDXXGXYXXXXXXXXXXXFXXXXXXXXXXXXXXXXXXXQXXLXXXXXXIXXXNXXRXXXYXXXXXXXXXNSIXX

SEQ ID NO: 54 - protein, 982 aa, Artificial Sequence
  Consensus sequence for bacterial LOX, CoLOXs and UfLOX2 protein sequences
  MISC_FEATURE (1)..(377): Xaa can be any naturally occurring amino acid
  MISC_FEATURE (379)..(385): Xaa can be any naturally occurring amino acid
  MISC_FEATURE (387)..(423): Xaa can be any naturally occurring amino acid
  MISC_FEATURE (425)..(433): Xaa can be any naturally occurring amino acid
  MISC_FEATURE (435)..(562): Xaa can be any naturally occurring amino acid
  MISC_FEATURE (564)..(573): Xaa can be any naturally occurring amino acid
  MISC_FEATURE (576)..(580): Xaa can be any naturally occurring amino acid
  MISC_FEATURE (583)..(590): Xaa can be any naturally occurring amino acid
  MISC_FEATURE (592)..(595): Xaa can be any naturally occurring amino acid
  MISC_FEATURE (597)..(600): Xaa can be any naturally occurring amino acid
  MISC_FEATURE (602)..(602): Xaa can be any naturally occurring amino acid
  MISC_FEATURE (604)..(614): Xaa can be any naturally occurring amino acid
  MISC_FEATURE (617)..(620): Xaa can be any naturally occurring amino acid
  MISC_FEATURE (622)..(623): Xaa can be any naturally occurring amino acid
  MISC_FEATURE (625)..(687): Xaa can be any naturally occurring amino acid
  MISC_FEATURE (689)..(695): Xaa can be any naturally occurring amino acid
  MISC_FEATURE (697)..(701): Xaa can be any naturally occurring amino acid
  MISC_FEATURE (706)..(706): Xaa can be any naturally occurring amino acid
  MISC_FEATURE (708)..(708): Xaa can be any naturally occurring amino acid
  MISC_FEATURE (710)..(723): Xaa can be any naturally occurring amino acid
  MISC_FEATURE (725)..(732): Xaa can be any naturally occurring amino acid
  MISC_FEATURE (734)..(741): Xaa can be any naturally occurring amino acid
  MISC_FEATURE (743)..(754): Xaa can be any naturally occurring amino acid
  MISC_FEATURE (756)..(756): Xaa can be any naturally occurring amino acid
  MISC_FEATURE (758)..(767): Xaa can be any naturally occurring amino acid
  MISC_FEATURE (769)..(782): Xaa can be any naturally occurring amino acid
  MISC_FEATURE (784)..(786): Xaa can be any naturally occurring amino acid
  MISC_FEATURE (788)..(789): Xaa can be any naturally occurring amino acid
  MISC_FEATURE (791)..(792): Xaa can be any naturally occurring amino acid
  MISC_FEATURE (794)..(798): Xaa can be any naturally occurring amino acid
  MISC_FEATURE (800)..(883): Xaa can be any naturally occurring amino acid
  MISC_FEATURE (885)..(902): Xaa can be any naturally occurring amino acid
  MISC_FEATURE (904)..(949): Xaa can be any naturally occurring amino acid
  MISC_FEATURE (951)..(956): Xaa can be any naturally occurring amino acid
  MISC_FEATURE (958)..(960): Xaa can be any naturally occurring amino acid
  MISC_FEATURE (962)..(967): Xaa can be any naturally occurring amino acid
  MISC_FEATURE (969)..(978): Xaa can be any naturally occurring amino acid
  MISC_FEATURE (981)..(982): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXPXXXXXXXXXXXXXXXXXXXXXXXXXXXXXXXXXXXXXLXXXXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXAKXXXXXADXXXXXXXXHXXXXHXXXXPXAXXXXXXXXXXXHPXXXXLXXHXXXXXXXXXXXXXXXXXXXXXXXXXXXXXXXXXXXXXXXXXXXXXXXXXXXXXXXXXXXXXXXRXXXXXXXLXXXXXRDDGXLXWXXXXXXXXXXXXXXYXXXXXXXXDXXXXXXXXEXXXXXXXXXXXXVXGXXXXXXXXXXLXXXXXXXXXXXXXXHXXXNXXQXXYXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXLXXXXXXXXXXXXXXXXXXXXXXXXXXXXXXXXXXXXXXXXXXXXXXLXXXXXXIXXXNXXXXXXYXXXXXXXXXXSIXX

SEQ ID NO: 55 - DNA, 23 bp, Artificial Sequence
  CoLOX forward primer (5'-3')
ctctctctctttctctctgttct

SEQ ID NO: 56 - DNA, 18 bp, Artificial Sequence
  CoLOX reverse primer (5'-3')
ctcgttcccttaccgtct

SEQ ID NO: 57 - DNA, 19 bp, Artificial Sequence
  UfLOX2 forward primer (5'-3')
tcgtccaacaggttctctt

SEQ ID NO: 58 - DNA, 19 bp, Artificial Sequence
  UfLOX2 reverse primer (5'-3')
ttctttccactcaccgcca

SEQ ID NO: 59 - DNA, 1773 bp, Artificial Sequence
  Codon-optimized coding sequence for WP_002738122.1
atggttaatacccctcctcccactccttgtctgccccaaaatgaaccagatgcgaatcggcgggctgattccctcaatcttcaacgccaagcctatagatacgactatcagtatctcccacccttagtcctcatggaatccgtgcctgcagcggaaaacttttcctttcagtacattactgaacggttggcggcaactgcggaactaccggccaatatgctggctgtcaaagtcaaatcttttttagatcccctcgatgagctacaagattatgaggacttctttgccattatccccttacccaaaatcgccaaagtctatcaaaccaatgatgcctttgccgaacaacgtctatcgggagctaatcccctagtattacatttactgaagccgggggatgctcgcgcccaagttctcaatcaaatccctagttctaagacagatttcgagccattgtttcaggtcaatcaagaattagcagcgggaaacatttatattgccgattatacgggtacggacattaattatctcggtccctctttgattcaagggggaacccatgccaaagggcgaaaatatttaccgaaacccagggccttcttttggtggcggaaaagtggcatcagagatcggggcaaattagttccgatcgctatccaatttggggaaaatgcggaaaagctttatactccttttgagaaaaacccccttgcttggctatttgctaaaatttgtgttcaggtggccgatagcaatcaccacgagatgaattcccatctctgtcgaactcattttgtcatggaaccgatcgcgatcggcacggcccggcaactggcagaaaatcatcccctcagtcttctgcttaagccacacctaagatttatgttaacgaacaaccatctgggacaagagagactgatcaaccctggtggaccggtggatgaattattggccggcaccttgggcgagtcgatggcactggttaaggatgcctacgcaaactggaatcttcgagactttgcctttcccaaagaaataagtaaccggggtatggacgatacggaacgactaccccactacccttaccgggatgatgggatgctggtttggcagtctattaatcagtttgtttctgattatctccattatttttacccaaacccccaagacatcactaacgatcaagaattgcaagcatgggccggagaattatctaattctgcggcagatcaagggggcaatgtgaagggaatgccggccaattttacggatgtagaggacttaattgaagtcgttaccacaattatttttatctgcgggccactgcattcagctgttaactatggtcagtatgattacatgacttttgccgctaatatgcccttggccgcttactgtgatcttccagaagcgattaaggatactacaggatcaataattggagatgccagaggatcaattaccgaaaaagacattcttcagctattgcctccttataaaaaggctgccgatcagttacaaagtctgttcactttatccgactatcgatacgatcaattgggctattacgataaagcttttcgagaactctatggccggaagtttgaggaggtttttgccgagggtgatcaggcaacaattacgggcttccttcgacaatttcagcaaaatctcaatatgaacgaacaagagattgatgccaataatcaaaaacggatcgtaccctatacctatctaaaaccttctctaatactcaatagcatcagcatttaa

SEQ ID NO: 60 - DNA, 1716 bp, Microcoleus vaginatus
atggtagacaatatgaaacctcttcttcctcaagacgacccgaacccagaacagcgccacgattccttgaatcgtcagcaacaagcttatcagtttgactatgagagtttatcacctttggcattattgaaagatgtgcccgcagtcgagaacttttcgagtaagtatcttgcagaacgcatattagcaacatcggaacttccagcaaatatgctggcagccgattctagaacttttctcgatcctctcgacgaactccaagactatgaagacttttttacttggctgccgctacctggagtggccaaaatttaccaaaccgatcgctcttttgcagaacagcgcctgtctggagcaaatcccatggtgcttcgcctgttacatcaggaggactctcgggcagaaacactggcacaactttgctgtttgcagccattattcgatcttcgcaaagagttacaggacaaaaacatttacattgccgattatacaggtactgacgaacactatcgcgggcctgcgaaagttgcaggaggaacctatgaaaaaggcagaaaatacttgccgaaaccacgggcttttttcgcttggcggtggacaggaatccgcgatcgcggtgaaatgacacctattgccattcaactagatcctaagcccggtagccatctgtataccccattcgatcctcctatcgattggctgtatgcgaaactctgcgtacaagtggcagatgctaatcaccatgaaatgagttcccatttaggtcgaactcatctggtgatggaaccaatcgcgatcgtcaccgcccgacagttggctaaaaatcacccgcttagcctgctgctgaaaccgcactttcgctttatgttgaccaacaacgatctggcgcgttctcacttgatcgctcccggcgggcccgtcgatgaattgctaggcggcaccttggctgagacaatggaactgactagagaggcgtgcagtacatggagtctcgatgaatttgccttgcccgctgaactgaaaaatcggggaatggatgaccccaatcaactgcctcactatccttaccgagatgatggattgttgctttgggatgcgattgaaacctttgtatcgggctatctgaaattcttttacccgacgaatgaggggatcgtacaagatgtggaactgcaaacctgggctaaagaattagcgtctgatgacggcggtaaagtcaaaggaatgccacaccacatcgacacagttgaacaattaattgcaattgtcacaactgtaatttttacctgtggtccacaacattcagcagtcaattttccccagtatgactatatgagttttgcggccaatatgcccttggcagcctaccgggacattcctggaattaccgcctcgggtcatctagaagtgattacggaaaatgacattttacggttgcttcctccgtacaaacgagctgctgaccaactgcaaattctgtttattttgtcagcttatcgatatgaccgtttgggttattacgataaatctttccgagaactctaccggatgagcttcgatgaagtttttgcgggaacgccgatccaacttttagccagacagttccagcaaaatttgaatatggcagaacaaaagattgatgccaacaatcaaaaacgagtcatcccttattttgctctcaagccttcgttggtactaaatagcatcagtatgtag

SEQ ID NO: 61 - DNA, 1716 bp, Oscillatoria nigro-viridis
atggtagacaatatgaaaccttctcttcctcaagacgacccgaaccaagaacagcgcaaagattccttgaatcgccagcaacaagcttatcagtttgactatgagagtttatcacctttggcattattgaaaaatgtgcccgcagtcgagaacttttcgagcaagtatattggagagcggatattagcaacatcggaacttccagcaaatatgctggcagccgattcgagaacttttctcgatcctctcgacgaactccaagactatgaagatttctttactctgctgccgctacctgctgttgccaaaatttaccaaaccgatcgctcttttgcagaacagcgcctgtctggagcaaatccgatggtgcttcgtttgttagatgccggcgatcctcgggcgcaaacactggcacaaatttccagctttcacccattattcgatctgggccaagagttgcagcaaaaaaacatttacgttgccgattacacgggtactgacgaacactatcgcgcgccttcaaaaataggaggcggaagctatgaaaaaggcagaaaattcttgccgaaaccgcgggcttttttcgcttggcggtggacgggaattcgcgatcgcggtgaaatgacaccaattgccattcaactagatcccacgccagatagccatgtctacaccccattcgatcctcctgtggattggctgtttgcgaaactctgcgtgcaagtagcagatgccaatcaccacgaaatgagctcgcatttaggtcgaactcatctggtgatggaaccaattgcgatcgtcaccgcccgacagttggcccaaaatcacccgctgagcctgttgctgaaaccgcactttcgctttatgttgaccaacaacgagctggcgcgttcttatttgatcgctcccggcgggcccgtcgatgaattgctaggcggtactttgccagagacaatggaaatagctagagaggcttgcagtacctggagtctcgatgaatttgcgttgcccgccgaactgaaaaatcggggaatggatgacacaaatcaactgcctcactacccttaccgagatgatggattgctgctttgggatgcgattgaaacctttgtatccggctatctgaaattcttttacccgacggagatcgcgatcgtacaagatgtggaactgcaaacctgggcccaagaattagcgtccgatcgtggcggtaaagtcaaaggaatgcctccgcgcatcaacacagttgaacaattaattaaaattgtcacaactataattttcacctgcggcccgcagcattcagcagtcaattttccccagtatgaatacatgagttttgccgccaatatgcccttggcagcctaccgagatattcccaaaattactgcttcgggcaatctcgaagtgattactgaaaaggacattttacggttgcttcctccgtacaagcgagcggctgaccaactgaaaattctgtttactttgtcagcttatcgatatgaccgtttgggttattacgataaatctttccgagaactctaccggatgagtttcgacgaagtttttgcgggaaccccgatccaacttttagccagacagttccagcaaaatttgaatatggcagaacaaaagattgatgccaacaatcaaaaacgagtaattccttacattgctctcaagccttcgttggtaatcaatagcatcagtatgtag

SEQ ID NO: 62 - DNA, 1929 bp, Crinalium epipsammum
atgccacaaccttatcttccccaaaacgaacccaatccagagaagcgcaataatgacttgagcgatcagcaacaggcttatgagtacgactataagtatctaccacctttggtattactgaaaaaaatacccgcattcgagaatttctcggctcaatatattgcggaacgggtagtagcaacctctgaactggttccaaatatgctggcagcaaaagctagatcttttctagatcctctagatgatataaaggactatgaagatttatttacactgttgccgttgcctgaagtcgcaaaagtttatcaaacaaataattccttcgctgaacaacgcctctcaggagcaaatccattcgtgattcgcctgctggatgaagatgaccctcgatcgcaagtcttagagcagattcctagttttaaagacgactttgaaccattgttcgatgtccgcaaagaattagcggctgggaacatctatattactgactatacaggcactgatgaatattatcgtggtccttctatggttcagggtggtacttatgaaaaaggtcggaaatatttaccaaaaccgctagctttcttttggtggcagcgcactgggatcagcgatcgcggtaagctggtgccaatcgctatccaactagatgccagcaagaatagcaaggtatatactccgacaaatagcaaggtatatactccctttgagcagaatccactcgattggctatttgcaaaactttgcgttcaaatagcagatggaaatcaccatgagatgagttcccacttatgtcggacacattttgtaatggaaccgatcgcaattggaactgctcaccaattggctgaaaatcatcctctcagccttctactcagaccacacttcctattcatgttgaccaataatcatcttggacagcaaaggttaataaatccaggtggtcctgttgatgagttgctggctggtactttaccagagtcaatggagctagttaaggatgcttatgaaggatggaatataaaggaatttgcctttccaaccgagattaagaatcggggaatggataatacggaaagactacctcactatccttaccgagatgatgggatgcttgtttggaaagctattcacacttttgtatctgactatgttaatcatttttacccaactcctgaagacatcactggagacactgaattgcaagcatgggctaaagaattgtccgatcaatccgctcaaactaatggtggcaaagtcaagggaatgccaacaagttttactactgttcaagaactgattgaaatcgttactacaatcatctttatctgtggtccccagcattcagcagtaaactacgctcaggatggatatatgacttttgccgctaatatgcccttagcagcttaccgtgatattcctaagcaaagtcacaagcctcaagaccaacctacagcaaccccatctgtagcagtgcaaactacagcagagcaaactacagcagagcaaactaaagcagtagaaattacagcagacaaagctacattagaccaaaatacagtattgcaaaagagagcagtacaaactaccacagtagaaattccagaagaccaaattacagaagaacaaattcttaagttgctgcctccctacaagagaactgccgatcaactgcaaagtctctttgttttgtcagcctatcagtacgaccgattgggctactatgaaaaagcctttcaacaactttataacgacaaatttgaggatgtttttaaagatgacaataatcaagcaattattgccatcgtcaggcagttccagcaaaatctgaatatggtagaacaagaaattgatgccaataataaaaagcgagtagttccttatctttacctaaaaccttctctaatactcaacagtattagcatttag

SEQ ID NO: 63 - DNA, 1647 bp, Dolichospermum circinale
atgcagccatttctacctcaaaatgacccgaacccctcacaacgccaatcttctctagagaaaggccgcaaagagtatcagttcatgtatgattttttgccgcctatggcaatgatcaaaagcgtacctcccgcagagaatttttctactaagtatattgctgaacggacattagaggcagcagaacttcctctaaatatgatggctgttaaaactcatgctatgtgggatcctttagatgaattgcaagattatgaggactttttcccagttttgcaaaaacctaatgtgatgaaaacctatgaaaccgatgattccttcgccgaacaacggctttgtggagtaaatccgatggttttacgtcaaattaagcaaatgccagctaactttgcctttaccattgaagaattacaggataagtttggcagttctattaatttaattgaaagattggccacaggaaatctatatgtcgctgattatagatccttggcgttcattcaaggtggcacttatgccaaaggaaaaaagtacctaccagcacctctagcttttttctgttggcgcacttcaggctttcaagatcgaggccaattagtccctgtagccattcaaatcaatcccaaagcaggtaaagccagccccttgctaactccttttgacgaccctttaacctggttttatgctaagtcctgtgtgcaaattgctgatgctaatcatcatgaaatgagtagccatttatgccggactcacctggtaatggaaccctttgctgttgtcactcctcgtcaactggctgaaaatcatcctctgagaatattactcaaaccccatttccggtttatgttggctaataatgatttagctcgcaagcgtctggttagtaggggcggttttgtggatgaattattagcaggaactctgcaagaatcattgcaaattgtggtagatgcctataaaagttggagtctagaccagtttgctctacccagagaactcaaaaatcgcggtgtgaatgatgtcaaaaacttaccacattatccttatcgggatgatggaattttgttatggaatgcgattaataagtttgtatttaactatttgcagctttattatcagagttcagcagacttgaaagcagacgcagaactgcaagcttgggcgcgggaattagtggctcaggatggtggtagagttaagggtatgagcgatcgcattgataccctagaacaattagtggagattgttactactatcatatatatttgtggtccgcagcattcggcggttaatttctcccaatatgaatacatgggttttattcctaatatgcccctagctgcttatcaaccaattcaacaaaagggtgatattaaagaccgtcaagccctcatagattttctaccacctgccaagcccacaagtacccaattatcaactgtgtacatactttcagactatcgttatgacagactgggatattatgaagaggaagaatttacagatccaaatgctgaccaagttgtgaataaatttcagcaagaattgaatatggtacagagaaaaattgaattgaataataagagacgtttagtaaattacaaatatctccaaccaagacttattctcaacagtattagtatttaa

SEQ ID NO: 64 - DNA, 1647 bp, Anabaena sp. AL09
atgcagccatttctacctcaaaatgacccgaaccccgcacaacgccaatcttgtctagagaaaggacgcaaagagtatcaattcatgtatgattttttgcctcctatggcgatgctcaaaagcgtacctcccgcagagaatttctctactaagtatattgctgaacggacattagaggcagcagaacttcctctgaatatgatggctgttaaaactcatgctatgtgggatcctttagatgaattgcaagattatgaggactttttcccaattttgcaaaaacctaatgtgatgaaaacctatgaaaccgatgattctttcgccgaacaacggctttgtggggtgaatccgatggttttacgtcaaattaagcaaatgccagctaactttgcctttaccatcgaagaattacaggctaagtttggcaattctattaatttaatcgaaagattggcaacaggaaatctatatgtcgctgattatagatccttggcgttcattcaaggtggcacttatgccaaaggaaaaaagtacctaccagcacctctggcctttttctgttggcgcagttcgggctttcaagatcgaggacaattagtccctgtagccattcaaatcaatcccaaagcaggtaaagccagccccttgctgactccttttgatgaccctttaacctggttttatgctaagtcctgcgtgcaaattgctgatgctaatcatcatgaaatgagtagccatttatgtcggactcacttagtaatggaaccctttgctgttgtcaccccgcgtcaactggctgaaaatcatcctctgagaatattactcagaccccatttccggtttatgttggctaataatgatttagctcgcaaacgtctggttagtaggggcggttttgtggatgaattattagcaggaactctgcaagaatcattgcaaattgtggtagatgcctataaaagttggagtctagaccagtttgctctacccagggaactcaaaaatcgcggtgtagatgatgtgaaaaacttgccacattatccttatcgggatgatggaattttgttatggaatgcgattaataagtttgtatttaactatttgcagctttattacaagagtccagcagacttgaaagcagacggagaactacaagcttgggcgcgggaattggtggctcaggatggtggtagagttaagggtatgagcgatcgcattgataccttagaacaattagttgagattgttactactatcatatatatttgtggtcctcagcattcggcggttaatttctcccaatatgaatacatgggttttattcctaatatgcccctagctgcttatcaagaaattcaacaaaacggtgatattgaagaccgtcaagccctgatagattttctaccaccagcaaagcccacaaatacccaattatcaactgtgtacatactttcagactatcgttatgacagactgggatattatgaagaggaagaatttacagatccaaatgctgaccaagttgtgaataaatttcagcaagaattgagtgtggtacagagaaaaattgaattgaataataagggacgtttagtaaattacgaatatctccaacccggacttattctcaacagtattagtatttaa

SEQ ID NO: 65 - DNA, 1659 bp, Aphanizomenon flos-aquae
atcataaatatcatgcagccatttctacctcaaaatgacccgaaccccggacaacgccaatcttctctagagaaaggacgcaaagagtatcaattcatgtatgattttttgcctcctatggcgatgctcaaaagcgtacctcccgcagagaatttctctactaagtatattgctgaacggacattagaggcagcagaacttcctctaaatatgatggctgttaaaactcatgctatgtgggatcctttagatgaattgcaagattatgaggactttttcccagttttgcaaaaacctaatgtgatgaaaacctatgaaaccgatgattccttcgccgaacaacggctttgtggggtgaatccgatggttttacgtcaaattaagcaaatgccagctaactttgcctttaccatcgaagaattacaggctaagtttggcaattctattaatttaatcgaaagattggccacaggaaatctatatgtcgctgattatagatccttggcgttcattcaaggtggcacttatgccaaaggaaaaaagtacctaccagcacctctagcctttttctgttggcgcagttcaggctttcaagatcgaggccaattagtccctgtagccattcaaatcaatcccaaggcaggtcaagccagccccttgctaactccttttgataaacctttaacctggttttatgctaagtcctgtgtgcaaattgctgatgctaatcatcatgaaatgagcagccatttatgtcggactcacctggtaatggaaccctttgctgttgtcaccccgcgtcaactggctgaaaatcatcctctgagaatattactcaaaccccatttccggtttatgttggctaataatgatttagcccgcaagcgtctggttagtaggggcggttttgttgatgaattattagcaggaactctgcaagaatcattgcaaattgtggtagatgcctataaaagttggagtctggaccagtttgctctacctagggaactcaaaaatcgcggtgtagatgatgtgaaaaacttgccacattatccttatcgggatgatggaattttgttatggaatgcgattaataagtttgtatttaactatttgcagctttattacaagagtccagcagacttgaaagcagacggagaactgcaagcttgggcgcgggaattagtggctcaagatggtggtagagttaagggtatgagcgatcgcattgataccttagaacaattagttgagattgttactactatcatatatatttgtggtcctcagcattcggcggttaatttctcccaatatgaatacatgggttttattcctaatatgcccctagctgcttatcaagcaattcaacaaaagggtgatattaaagaccgtcaagccctgatagattttctaccacctgccaagcccacaaatacccaattatcaactgtgtacatactttcagactatcgttatgacagactgggatattatgaagaggaagaatttacagatccaaatgctgaccaagttgtgaataaatttcagcaagaattgaatgtggtacagagaaaaattgaattgaataataagggacgtttagtaaattacgaatatctccaacccagacttattctcaacagtattagtatttaa

SEQ ID NO: 66 - DNA, 1644 bp, Aphanizomenon flos-aquae
atgaagccatttttacctcaaaatgacccaaatcccacacaacgccaatcttccctagagaaaggtcgcaaagagtatgaatttaggtatgattttttgcctcctatggcgatgctcaaaaacgtacctccctctgagaatttttctaccaagtatattgctgaacggacaatagagacagcagaacttcctagcaatatgatggctgtcaaagcccatgctatgtgggaccccttagatgaattgcaagactatgaagacttttttccagttttgcaaaaacctaatgtgatgaaaaattatgaaacagatgattccttcgccgaacaacggctttgtggcgtgaatcctgtggttttatgtcagattaagcaaatgccagccaactttgcctttaccatcgaagaattgcaagctaagtttggcaattctattgatttaagagaaagactggcaaccggaaatctctatgtagctgattatagacctttggcgttcattcgaggtggcactttcgccaaagggaaaaagtatttaccagcaccactagcctttttctgttggcggagttcaggctttcaagatcgtggtcaattagtacctatagcgattcaaatcaatcccaaggaaggaaaagccagcccattgctgaccccttttgatgactcttctacctggttttatgccaagtcctgtgtgcaaattgctgatgctaatcatcatgaaatgagtagccatttatgccggactcactttgtgatggaaccctttgcggttgttactcctcgtcaattagcccagaaccatccgctgagaatattactaaaaccccatttccggttcatgttggccaacaatgatttaggtcgccagcggttggtgaatagaggcggtcctgttgatgaattattagcgggaactctgcaagaatcactgcaaattgttgtagatgcttatacagattggagattggatcagtttgcgctgccaacagaactcaaaaatcgcggtgtggatgatgtgaaaaatttgccccactatccctatcgggacgatgggatcttgttgtggaacgcgattaacaagtttgtgtttaactatttggagctttactacaagagtcccgcagacttgacagcagatgtcgaactacaagcttgggcgcgggaattagtggctcaggatggtggtagagtcaaggggatgagcgatcgcattgatactttgaaacaattagtagagattgttactactatcatttacacttgtggacctctgcattctgctgttaatttcccccaatatgaatacatgggtttcattcccaatatgcctctggctgcttatcaaccaattaaaaaagaaggcgtttgtacccgcaaggaactgatagattttttaccagctgccaaaccaacaagtagccaattaacaactttattcacactctcagcctatcgttatgacagactaggatattatgaagaggaagaatttgaagaccccaatgctgacgatgttgtgaataaattccagcaagaattgaatgtggtgcaaagaaaaattgagttgagcaacaagggacgtttagtaaattacgaatatctacaacccagacttatcctcaacagcatcagcatttaa

SEQ ID NO: 67 - DNA, 1644 bp, Nostoc punctiforme
atgaaaccatacctccctcagaatgatcctgaccctacaaaacgtcaaatattgctagagagaaatcaaggggagtatgaatttgattacgactttttggtacctatggcaatgctaaaaaatgtaccttctatagaaaacttttcaactaagtatattgctgaacggacattagagacagcagaactgcctataaatatgttagccgttaaaacccgttctttatgggaccctttagatgaattgcaagactatgaagactattttccagttttgcctaaacctaatattatcaaaacataccaaagtgatgactctttttgtgagcaacggctttgtggggcaaatccttttgttttacgtcgaattgagcagatgccagatggcttcgcctttaccattttagaattgcaagaaaaatttggtgactctattaacttagtagaaaaacttgcgaatggaaatttatatgtagctgattacagagcgcttgcgtttgttaaaggaggtagttatgaaagaggtaagaagtttttaccaacccctatagctttcttttgttggcgcagttctggttttagcgatcgcggtcaactagtaccgattgttatccaaatcaaccccgcagatggcaaacagagccagctaattacacctttcgatgaccctttaacctggtttcatgccaagctttgtgttcaaattgctgatgctaaccatcatgaaatgagtagccatctgtgtcgaactcactttgttatggaaccctttgctattgtcacagcccgtcaactagccgagaaccatccccttagcttactgctaaaaccccacttccgtttcatgttggctaataatgacttggctcgtaagcgcctaattagtagaggtgggcctgttgacgaattgctagccggaactctgcaagagtcattgcaaattgtcgttaacgcatatacagaatggagcttagatcagttttccttacctactgaactaaaaaatcggggtatggatgatccagacaacttacctcactatccctatcgagacgatggcttattattgtggaatgccattaaaaagtttgtgtctgaatacttgcagatatactacaaaactccccaagatttagcagaagacttggaattacaaagttgggtgcaggaattagtttcccaatcaggcggacgagtcaagggtattagcgaccgcatcaacacattagaccaattagttgatattgctactgcggttatcttcacctgtgggccgcaacacgctgctgttaactactcacaatatgaatatatgactttcatgccaaatatgcctcttgctgcttataaacaaatgacatcagaaggcactattcctgaccgtaaaagtctattatcatttctgccaccgtcaaagcaaactgctgaccaattatcgattttatttatcctgtcggcctaccgttatgacagattagggtactacgatgataaatttttagacccagaggctcaggatgttttagctaaattccagcaggagttgaatgaagcagagcgggaaattgagttgaataacaagagtcgtttaataaattacaactatctcaaaccaaggcttgtgactaatagtattagcgtgtaa

SEQ ID NO: 68 - DNA, 1659 bp, Mastigocoleus testarum
atgaaaccctatcttcctcaaaatgaccctaaccctgagaagcggaaagattggcttaataaaaatcgtgaagagtaccaatttaacttcaattatctttctcccctcccattaattgatgatgttcctaataatgaggctttttcccctaaataccttgcagaacgcttacctttaactttcggtaaattatctgctaataccttgggaattagacttcgctctttttgggatccttttgatgaattccaagattatgaggactttttccctgttttaccaacaccggaattactcaagacctaccaaaatgacgaatactttgccgaacaaaggctaagtggagtaaatcctatggtaatacgcagtattaaggaactaccccctcactttgcattttccatccgagatttacaggctgaatttggtacatccctaaatttagagcaagaactgaacaacggaaatctatatatcgcagactataccagtctttcatttgttcggggaggaagctatcttaggggtcgaaagtctttacctgcacccatagccttattttgctggcgtaattctggttattgcgatcgcggagaattaaccccaatcgctattcaactagtaccggaacttggtacgggaagtagaattttaactccttttgattctcaccttaactggttatatgccaaaatttgtatgcagattgcagatgcaaatcatcatgaaatgagtagccatttatgtcatactcacctagtgatggaacctttcgcagttgtaacagctcgacagctagctgaaaatcatccgttgggtttgttgctgcgtccccacttccggttcatgctccacaacaatgaattagcccgtaaaaatttaattaatcaaggtgggtacgttgataatctccttgggggaaccttaagagaatccctacaaattgtccgggatgcttactttaaaaatgctgaagaattttggagcttagacgaatttgctttacctaaagaaatcgcaaatcgtggcttagatgatactgatcgcttaccccactacccctacagagatgatggaatgttactgtggaatgcgatcgagaaatttgtatcgaattatttgagtatatattatccaaatccaggggacattaaagatgatcgcgaactgcaagcttgggctgcagaattagttgctgctgatggtggacgagtaaaaggggtaccctcacaatttgaaaatctgcaacaattaatcgacgttgtaactggcattatttttacatgcggacctcagcactctgctgtaaattatccccaatatgaatatatggcatttgttccgaatatgcccctcgcaggttaccaagctgtggattctaatcccaacatggatctgaaaagtttaatggcgtttctccccccacccaatcaaactgcagatcaactacaaattatttacggattatcagcttatcgttatgaccgcttgggttactacgaccgagaatttagcgatcctcatgctgaagaagttgtcagactatttcaacaagatttaaatcaggtggaacgtaaaattgagttacgtaacaaaaatcgcttggttgaatataacttcctcaagccttctttagttcttaatagtatcagtatataa

SEQ ID NO: 69 - DNA, 1644 bp, Nostoc calcicola
atgaaaccataccttcctcaaaatgaccctgacccgataaaacgcaaatattccttagagcataagaaagaagaatacgaattcgatcacgactttttatcaccgatggcaatgctcaaagatgtacctgctgtcgaaaatttttctaccaggtatattgctgaacgtacagtagagacagcagagcttcctatcaatatgttggctgttaaaacccgtgctttatgggaccctttagatgaattgcaagactatgaagactattttccagtcttgcctaaacctaatgtcatcaaaacataccaaacagatgattctttttgcgaacaacgcctgtgtggggcgaatcctatggctttacagcaaattaaagagatgccgttggggtttgaatttaccatcgaagaactgcaagaaaagtttggcgaatctatcaatttggtagaaaaacttgctgatggaaatttatatgtgactgattacagaccgctttcatttgtaaaaggtggtacttacgagagaggtaaaaagtatttaccaacacccctagcttttttctgttggcggagttctgggtttagcgatcgcggtcaactcgtacctattgccatccaactcaatcccgcagtcggcagacaaagccaattaatcacaccttttgacgatcctttaacttggtttcatgccaaactttgtgttcaaattgctgatgctaaccatcatgagatgagtagccatctttgccgaactcactttgtcatggaacctttcgccattgtcacagcccgtcaattagctgataatcatcctctcaatttgttattaaaaccccacttccgtttcatgttggctaataatgacttgggtcgcaagcgcttagttaataggggcggacctgttgatgaattgctagctggaactctgcaagaatcattgcaaattgtcgtcaacgcctataaagaatggagtctagatgaatttgccttacccactgaaatcaaaaatcggggtatggatgataaactaaaattgcctcactatccctatcgagacgatgggatgctattgtggaatgctattaaaaagtttgtgtctgaatacttgaagttatactataaaactccccaagatttgacagcagacttagaattgcaagcttgggcgcaggaattagtttctgaatcaggcggacgagttaaaggcgttccctctcgcattgaaaaattagaacaattagttgatattgcgactgcggtaattttcacctgtggaccacaacacgctgctgttaactattcacaatatgaatatatgaccttcatgccgaatatgccccttgctgcttataaacaaatgacagcagaaggcactattgctgaccgcaaaagcctattatcatttctgccaccgtcaaagcaaactgccgatcaattgtcgattttattcatcctgtcagcttaccgttatgataggttaggttactatgacgataagttcgcagacccagaagctcaggatattctagttacatttcagcaggatttgaacgaggtagagcgtaaaattgagttgaacaacaagagtcgtttaataaagtataactacctcaaaccaaggcttgttaccaatagcattagcgtctaa

SEQ ID NO: 70 - DNA, 1644 bp, Calothrix brevissima
atgaaaccatatcttccacagaatgatcctgaacctacacaacgcaagaatttcctggagcgcaaacaaggagagtatgaatttgatcacaaatttttaaagcctatggcaatgctaaaaaatgtaccctctattgaaaatttttctactaaatatattgctgaacgtacggtagagacggcagaacttcctctaaatatgttagccgttaaaactcgttctttgtgggatcctttagatgaattgcaagactatgaagactattttccagttttacctaaacctaatgtcatcaaaacataccaaactgataactctttctgtgaacaacggctttgtggtgcaaatcctttagttttacgccaaattcagcagatgccagatggctttgcctttaccatttcagaactgcaagaaaagttcggtgactctatcgacttagaagaaagacttaaaactggaaatttatatgtagctgattacagagcgcttgcatttgttaaaggaggtacttatgaaagaggtaagaagtatttacccactcccatagcgttcttttgttggcgtagttctggttttagcgatcgcggtcaactagtaccgattgctatccaaatcaatcccacagatggtaaacagagtcagttaatcacaccttttgatgagcctttggtctggtttcatgccaaactttgtgttcaaatcgctgatgctaaccatcatgaaatgagtagtcatctgtgtcgaactcactttgtaatggaacccttcgccattgtcacagcccgtcaactagcagataaccatcccctcaacttattgcttaaaccccacttccgtttcatgttagctaataatgaattaggtcgtcagcgcctagttaatagaggtgggcctgttgacgaattgctagcgggaactttgcaagagtcattgcaaattgtcgtcaacgcatataaagaatggagcttagatcagttttctttacccaccgaactcaaaaatcggggtatggataattcagacaaactacctcactatccttatcgagacgatggcttactattgtggaatgccattaaaaaatttgtgtctgaatacttgaaactatactataaaactcctcaagatttaacagcagactttgaattacaatcttgggcgcaggaattagtttcccaatcaggcgggcgggtcaagggcgttagcgaccgcattacaacattagaccaattaattgatattgctacggcggttattttcacctgtgggccacaacacgctgctgttaattactcacaatatgaatatatgactttcattcccaatatgcccctcgctgcttataaacaaataacatcagaaggaaatatccctgatcgtaaaagcctactatcatttcttccaccatcaaagcaaactgctgatcaattatcgattttattcatcttgtccgcctaccgttatgacagattagggtactatgacgataaatttttagatccggaggcacaggagattttagttacatttcagcaggagttgaacgaagcagaacggcaaattgagttgaacaataaaagccgtttaataaattacgactatctgaaaccaaggcttgttactaatagcatcagcgtataa

SEQ ID NO: 71 - DNA, 1641 bp, Nostoc sp. DB3992
atgaaaccatatttaccacaaaaagatcctgatgttaaggtccgaatcaattggctagataaaaatcgagaagagtacaaatttaattacgattatctagctcctctaccagtaattgataaagttcctcataaggaaatattctcggcagaatatactactaaacgtttggcaagtatggcaagtcttgcaccaaatatgctagctgccaaagccagaaacttcttagacccattagatgaattggaagaatatgaagaacttttgtcactactaccaaaacccgatgtcataaaaaattacaaaacagactcctgttttgcggaacaacgactctctggagcgaacccattagctatccaaaaaattgatgtattacctgataattttgctgtcacagatgcacattttcagaaggttgcaggtacagaatttactttggaaaaagcactcaaggaaggcaagctgtatttcttagattatcctttgttatctgatattaaaggtggtgtctacaataatgttaaaaagtaccttcccaagccacaagctctattttattggcaaagtaatgatagtcctaatggtggttctctagtgcctgttgccatccagattaatcatgactctggtggaaaaagcgtgatttatacaccagatgacccccatttagattggtttttggcaaaaacctgcgttcaaattgctgatggcaaccatcaagaattgggtagtcatttcgcctatacccatgcagttatggctccgtttgcaattgtaactgcgcggcagctagcagaaaatcatcccatcgccttactgttaaaaccccacttccgttttatgctatttgataacgatttggggcgcactcagtttttacaacctggaggcccggttgatgagtttatggcaggttcattggcggagtctcttggatttgtagcgaaggtttatgaagaatggagtgtggaaaaatttaccttccctcggttaataaaaagtcgccgaacggatgacccagaaattttaccgcactttcctttccgggacgatggtatgttaatttggaatgccgtcgaaaagtttgtgtatgaatatttgcaactctattacaaaacctcacaggatctaattgatgactatgagttgcaaaattgggctagagaattagtggctcaagatggtggtagagtcaagggaatgccagccaagattgagactctagaacaactgattgaaatcatcagtgtggtagtattcacttgcgctcctctacactctgctttgaatttttctcagtacgaatatatggcttttgtacccaatatgccctatgcagcttatcacccaattccagaaactaaaggtgtggatttggaaactattatgaagatacttcctccctttaaacaagctgccgaccaggtgatgtggactgagattttaacatcataccactatgataaattgggtttttatgatgaggagtttgccgatccattagcgcaggaaattgtggtgcaattccaacagaatttgcatgaaatagaacggcaaatagacattagaaatcaaactcgtcccataccttataactacttcaagccttcgcaaattattaacagcattaatacttga

SEQ ID NO: 72 - DNA, 1632 bp, Aliterella atlantica
ataaaaccatatttacctcaacacgagcctgatgcgatcgcgcggcaaaatcgcttaatcaaaaaccgcgctgattatgttctcgactataactatctgccacctattcctttgcaaactcctgttcctcaacaagaacgtttttctgctgaatacactgcaaggcgtttagctagttttgctaatctcgtccccaatatgttgatggcgagggcgagaaatgctttcgatcctttagatacgttagaggaatacgcggacttattaccagtcttaccaaaacctaatgtcatcaaaaattatcaagcagattggtgttttgccgaacaaagattatctggtattaacccgccagctatccgccgcatagatgctttgccagaaaatttgcccatctctaactcttcgtttcaacactctgtaggtgcagaacataatctggaacaagcactcaaagaaggtaagttgtattgtttagactacccgttgttatctggtattggaggcggtaattaccagaatttacctaaatatctgcccaaaccgcaagcgctcttttattggcgtagtgataatagcaaaatcggcggctctttagttccggtagcgattaaaattctcaatgaattgggagggaaaaatttagtctatacgcccaatgatgcacctctcgactggtttcttgccaaaacctgcgtgcaaatggcagatgcaaaccatcaggaattaggcactcattttgctaaaactcatgctgttatggctcctattgcggcaattacagctagggaattaggcgaaaaccatcctttaactttgctgctaaaacctcatttccggttcatgctgtttgataatgagttaggacgcacgcagtttttgcaacctactggtcctactgaagaactgctagctggaacgctggaagaatctgtgcaattggtcgtgcaagcttatgaggaatggagtatagatactacttttcctttagaattgcagcaacggcaaatgcatgacccagagattttacctcattacccgttccgagatgatggcatattagtctggaatgctatacatcagtttgttactgaatatttgcagatttactaccacactccgcaagatatcagtgcagactacgaggtgcaaaattgggctagggaattggtagatagcggtcgagttaaaggaatgccagagagcattgatactctagcacaactaattgacattatcgctgtagtcatctttacctgcgctcctctgcattcttgcttgaatttagcccagtacgaatacatgactttcgtgccaaatatgccttatgcagcctaccaccctattcccactactaagggcgtagatatggcaactattgtcaaaattatgccgccttttcaaagagcgatcgatcaaatattgtggacggatattttgagcgctttccaatatgacaagttgggtttttatgaggaagattttgccgatcccaaggctcaggaagtgctacagcgctttcaagataacttgcagcaggtagaagaaaagatagaaatgcacaatcagattcgcccaataccttacaactacctcaagccttctcggattatgaacagcattaatacttaa

SEQ ID NO: 73 - DNA, 1641 bp, Scytonema sp. HK-05
atgaaaccctacttaccccaacatgacccaaatcctgaagctcggagaaattggctggaacaaaaccgagaagactacaaatttgaccacaattatttggctcccataccaatacttgataaggtgcctcataaagaactcttctcgccgcaatataccgctaagcgcttagcaagtatggcggatctcgtacccaatatgcttgctgccaaagccagaaatttcttcgatccactggatgaattggaagaatatgaagccctgttgtcgatattaccaaagccctctgtcataaaaaattacaaaacagattcgtgtttcgccgagcaaagactctctggggcaaacccgatggcaatgcacaggattgacgagctaccagaaaaattccctgtgacaaacgaccactttcaaaaagctgtaggtgcagaacacaatttggaggcggcactcaaagaaggcaaactctatttattagattatcctttgctatttgacattaaaggcggtacctaccagaacattaaaaagtaccttcccaagccgcaggctctattttactggcaaagcaatggcaataaaaatagtggttctctggtgcctatcgccattcagatccataatgatactggtggagatagcctgatttacacaccagatgacccccatttagattggtttttggcaaaaacctgcgtacaaattgctgatgccaaccatcaggaattgggtagccattttgcacgtactcatgcagtcatggctccatttgcaattgtcactgctcgacagttgggagaaaaccatcccctcgccttacttctgaaaccccacttccgattcatgctctatgataacgatttgggacgtactcactttttacaagcaggaggtccggttgatgagtttatggcaggtacgttgcaggagtctcttggtttcgttgccaaagcctacgaagaatggagtttagacaatgctgtcttcccgacggaagtgaagaatcgcaaaatggatgatccagacattttgccgcactatcctttccgggacgacgggatgttactctgggatgcggtcaaaaagtttgtgactgaatacttgcaactctattacaaaactccccaagacttgagcgaggattatgaattgcaaaattgggcgagagaattggctgcccaagatggtggttgtgtcaaggggatgccagagaaaattgagaccatagagcaactcattcatgttgtgactgtagtcgtcttcacctgcgctcctctccactcggctttgaatttttcccagtacgaatacatggctttcgtacccaatatgccttatgcagcctattaccccgttccagaaacaaagggtgtggatatgcagactatcatgaagatgcttccaccttttaagcaagctgctgatcaggtgatgtggtcggatattttgacatccttccattacgacaaattgggtcactatgatgaagaatttgccaacccaatggctcaggcaattcttttgcagttccaacaaaatttgcatgaagtggaacgacaaatagaaatcaaaaatcaatctcgtccaataccatataactacctcaagccttctgaaattattaatagcatcaatacttga

SEQ ID NO: 74 - DNA, 1620 bp, Nitrosococcus watsonii
atgaatacctcgctaccgcaaaatgattccgatccccagggccgaaaggatcggcttgaaagacggcgagcgctgtatgtatttaattacgattatgtgccgcccataccgatgattgataaggtccctcatgaagagtatttcagtccaaaatacactgcagaacgtttggcgtccatggcgaagctagcgcctaatatgcttgccgctaaaaccaagcggctcttcgacccgcttgatgaactgaatgaatatgatgagatgttcatcttcctggacaaaccgggtattgtccgcggctatcgaacagatgaatcctttggggaacaacgcctatccggcgttaatcccatgtcaatacgccgccttgataaactccccgaagactttccgatcatggatgagtatctggaacaaagtttgggttctccacatactctcgcgcaggcactccaagaaggacggctttattttctggagttccctcaattggctcatgtgaaagaaggcggactttaccggggacggaaaaaatacctgcccaagccccgggctttattttgctgggacgggaatcatttgcagccggtggccatccaaattagcggacaaccaggggggcggctctttattccccgggattctgatttagattggtttgtagccaagttgtgcgtccagattgccgatgccaatcatcaggaacttggcacccactttgcccgtactcatgtggtgatggcgccttttgccgtggtgacccaccgtcaattggcggaaaatcatcctctgcatattctgttgcggcctcatttccggttcatgctctacgacaatgatttggggcgtacccgatttatccagccagatggtccggtggagcacatgatggcgggcactctagaagagtccattgggatttccgctgccttttataaggaatggcggctagatgaagccgcctttcccattgaaattgcccgccgcaagatggatgacccggaggtattgccccattatcccttccgggacgatgggatgctgctatgggacggtattcagaaatttgtgaaggaatacttggccctttattatcaaagtcctgaagatttggtccaggaccaggaactgcggaactgggctagggagcttaccgccaatgacgggggccgggtagcgggtatgccggggcgtattgaaaccgtcgatcagcttaccagcatccttagcacggtcatttatacttgtgcacccttgcactcggcactgaattttgcccagtacgagtatatcggctatgtcccgaatatgccctatgcggcctatcaccccattcccgaagagggaggcgtggatatggaaacgctgatgaaaattctgcctccctacgagcaggctgcgctgcagctgaaatggaccgagatcctcacttcctaccattatgatcgcttgggacattatgatgaaaaattcgaagatccccaggcgcaagccgtagtggaacaattccaacaggagctagcggcagtagaacaggagattgatcagcgtaaccaagaccgtccgctagcctacacgtatctgaagccttcggaaattatcaatagcattaatacctga

SEQ ID NO: 75 - DNA, 1773 bp, Microcystis sp. 0824
  CDS (1)..(1773)
atggttaatacccctcctcccactccttgtctgccccaaaatgaaccagatgcgaatcgccgggctgattccctcaatcttcaacggcaagcctatagatacgactatcagtatctcccacctttagtcctcatggaatccgtgcctgcagcggaaaacttttcccttcagtacattactgaacggttggcggcaactgcggaactaccagccaatatgctggctgtcaaagtcaaatcttttttagatcccctcgatgagctacaagattatgaggacttctttgctattatccccttacccaaaatcgccaaagtctatcaaaccaatgatgcctttgccgaacaacgtctatcgggagctaatcccctagtattacgtttactgaagccgggggatgctggcgcccaagttctcaatcaaatccccagttctaagacagacttcgagccattgtttcaggtaaatcaagaattagcggcaggaaacatttacattgccgattatacgggtacggatgctaattatctcggtccctcttttgttcaagggggaacccatgccaaagggcgaaaatatttaccgaaacccagggccttcttttggtggcggaaaagtggcatcagagatcggggcaaattagttccgatcgctatccaatttggggaaaatgcggaaaagctttatactccttttgagaaaaacccccttgcttggctatttgctaaaatttgtgttcaggtggccgatagcaatcaccacgagatgaattcccatctctgtcgaactcattttgtcatggaaccgatcgcgatcggcacagcccggcaactggcagaaaatcatcccctcagccttctgcttaagccacacctaagatttatgttaacgaacaaccatctgggacaagagagactgatcaaccctggtggaccggtggatgaattattggccggcaccttgggcgagtcgatggcactggttaaggatgcctacgcaaactggaatcttcgagactttgcctttcccaaagaaataagtaaccggggtatggatgatacggaacgactaccccactacccttaccgggatgatgggatgctggtttggcagtctattaatcagtttgtttctgattatctccattatttttacccaaacccccaagacatcactaacgatcaagaattacaagcatgggccagagaattatctaattctgcggcagatcaagggggcaatgtgaagggaatgccagccaattttacggatgtagaggacttaattgaagtcgttaccacaattatttttatctgcgggccactgcattcggccgtcaactatggtcagtatgattacatgacttttgccgctaatatgcccttggccgcttactgtgatcttccagaagcgattaaggatactacaggatcaataattggagatgccagaggatcaattaccgaaaaagacattcttcagctattgcctccttataaaaaggctgccgatcagttacaaagtctgttcactttatccgactatcgatacgatcgattgggctattacgataaagcttttcgagaactctatggacggaagtttgaggaggtttttgccgagggtgatcaggcaacaattacgggcttccttcgacaatttcagcaaaatctcaatatgaacgaacaagagattgatgccaataatcaaaaacggatcgtaccctatacctatctaaaaccttctctaatactcaatagcatcagcatttaa

SEQ ID NO: 76 - protein, 590 aa, Microcystis sp. 0824
MVNTPPPTPCLPQNEPDANRRADSLNLQRQAYRYDYQYLPPLVLMESVPAAENFSLQYITERLAATAELPANMLAVKVKSFLDPLDELQDYEDFFAIIPLPKIAKVYQTNDAFAEQRLSGANPLVLRLLKPGDAGAQVLNQIPSSKTDFEPLFQVNQELAAGNIYIADYTGTDANYLGPSFVQGGTHAKGRKYLPKPRAFFWWRKSGIRDRGKLVPIAIQFGENAEKLYTPFEKNPLAWLFAKICVQVADSNHHEMNSHLCRTHFVMEPIAIGTARQLAENHPLSLLLKPHLRFMLTNNHLGQERLINPGGPVDELLAGTLGESMALVKDAYANWNLRDFAFPKEISNRGMDDTERLPHYPYRDDGMLVWQSINQFVSDYLHYFYPNPQDITNDQELQAWARELSNSAADQGGNVKGMPANFTDVEDLIEVVTTIIFICGPLHSAVNYGQYDYMTFAANMPLAAYCDLPEAIKDTTGSIIGDARGSITEKDILQLLPPYKKAADQLQSLFTLSDYRYDRLGYYDKAFRELYGRKFEEVFAEGDQATITGFLRQFQQNLNMNEQEIDANNQKRIVPYTYLKPSLILNSISI

SEQ ID NO: 77 - DNA, 1677 bp, Acaryochloris sp. RCC1774
  CDS (1)..(1677)
atgcccagcctgcctcagaacgatcccgacctacaagcgcgtcaagctctactcaagcagcagcaggagcgctatcaatttaacttcgagtatctggcaccgctggccatgctggatgaagttcccaaggatgagaatttctccggcgcttatcttgccgaacgtctaacgcgcgccgctgatctcccggtcaatatgttggcggcgaaggctcattctctcttagatcccctagatcgcctggaggattatgacgacttgtttaccttgctgcctaaaccggctattgccaatacattccaaacggatgaagtctttgctgaacagcggttgtcaggagcgaatccaatggcaattcgcagacttgatcccagcaatccgccgtcggcatatctcaatattaagcaacagctagcaaccaagggtaaaacgctcgtcgagcgtaatctttactacgttgactacagcgaactcagctttatccaggggggaacctacgccaagggcaaaaagtacctacccactccctttgctctttttagttggcagtcaatggggtatcgcgatcacaagaccagcgatcatggcgaactactgcccattgccattcagattcagcaaaacaacagtggtcgagtctatacgccccgagatgcccatcttgactggttatttgccaaactctgtgtccagattgctgacggtaatcatcacgagatgagcagccatctgtgtcgcactcattttgttatggaacccattgccgtagtcactgcacgccaactggccgaagatcacccactctatattttactgcagcctcacttccgatttatgttggccaacaacgagctgggccggaagcagctcatacaacacggtggcccggtagataagcttttggccgggacgctggccgaatctttgcaggttgtcaaaaattcctttgaatcctggagccttgatcagttttccttccccaccgaggttcgcaatcgcggtatggatagcccagatctgccccatttcccttaccgagatgacggccagctcgtctgggatgcgatttataaatttgtgaccgactacctgcggctcttttatgctgactctgacgctcttaaaaacgatgaagagctacagagctggcttaaagaactgcgcgatccgcagggcggacgcatcaaaggcgtgcccgagcatattcaagcgctagagccgctcgttgaaatggtgaccaccattatttttacctgtggcccgcagcactgtgccgtcaactatacccaatatgaatatatggctctggcctccaacattcccctagcggcctatcaagatctaacaggtcttgaaaacggctccgagactaaacctgccatcactgacgaagcccacctgatgcagtatctgccgccctaccagcaggctgcaggacagcttcaaatcatgaatattttgacggactatcgctatgacaagttgggctactatgaccgcaccttcaaggatgcttttgctggaagcagttttgacaccgctgttgatgctgttgtcgagcagttcaagcagaatctacgagtcgtagagactgaaattgatctcgataaccgcaaacgcgtgattgagtatccctacctaaagccctctttaatcttgaatagcatcagtatctag

SEQ ID NO: 78 - protein, 558 aa, Acaryochloris sp. RCC1774
MPSLPQNDPDLQARQALLKQQQERYQFNFEYLAPLAMLDEVPKDENFSGAYLAERLTRAADLPVNMLAAKAHSLLDPLDRLEDYDDLFTLLPKPAIANTFQTDEVFAEQRLSGANPMAIRRLDPSNPPSAYLNIKQQLATKGKTLVERNLYYVDYSELSFIQGGTYAKGKKYLPTPFALFSWQSMGYRDHKTSDHGELLPIAIQIQQNNSGRVYTPRDAHLDWLFAKLCVQIADGNHHEMSSHLCRTHFVMEPIAVVTARQLAEDHPLYILLQPHFRFMLANNELGRKQLIQHGGPVDKLLAGTLAESLQVVKNSFESWSLDQFSFPTEVRNRGMDSPDLPHFPYRDDGQLVWDAIYKFVTDYLRLFYADSDALKNDEELQSWLKELRDPQGGRIKGVPEHIQALEPLVEMVTTIIFTCGPQHCAVNYTQYEYMALASNIPLAAYQDLTGLENGSETKPAITDEAHLMQYLPPYQQAAGQLQIMNILTDYRYDKLGYYDRTFKDAFAGSSFDTAVDAVVEQFKQNLRVVETEIDLDNRKRVIEYPYLKPSLILNSISI

SEQ ID NO: 79 - DNA, 1647 bp, Anabaena sp. WA102
  CDS (1)..(1647)
atgcagccatttctacctcaaaatgacccgaacccggcacaacgccaatcttctctagagaaaggacgcaaagagtatcaattcatgtatgattttttgccgcctatggcgatgctcaaaagcgtacctcccgcagagaatttttctactaagtatattgctgaacggacattagaggcagcagaacttcctctaaatatgatggctgttaaaactcatgctatgtgggatactttagatgaattgcaagattatgaggactttttcccagttttgcaaaaacctaatgtgatgaaaacctatgaaaccgatgattccttcgccgaacaacggctttgtggggtgaatccaatggttttacgtcaaattaagcaaatgccagctaactttgcctttaccatcgaagaattacaggataagtttggcaattctattaatttaatcgaaagattggccacaggaaatctatatgtcgctgattatagatccttggcgttcattcaaggtggcacttatgccaaaggaaaaaagtacctaccagcacctctagcctttttctgttggcgcagttcgggctttcaagatcgaggccaattagtacctgtagccattcaaatcaatcccaaggcaggtaaagtcagccccttgctaactccttttgatgaccctttaacctggttttatgctaagtcctgtgtgcaaattgctgatggtaatcatcatgaaatgagtagccatttatgccggactcacctggtaatggaaccctttgctgttgtcaccccgcgtcaactggctgaaaatcatcctctgagaatattactcaaaccccatttccggtttatgttggctaataatgatttagctcgcaagcgtctggttagtaggggcggttttgtggatgaattattagcaggaactctgcaagaatcattgcaaattgtggtagatgcctataaaagttggagtctagaccagtttgctctacctagggaactcaaaaatcgcggtgtagatgatgtgaaaaacttgccacattatccttatcgggatgatggaattttgttatggaatgcgattaataagtttgtatttaactatttgcagctttattacaagagtccagcagacttgaaagcagacggagaactgcaagcttgggcgcgggaattggtggctcaggatggtggtagagttaagggtatgagcgaccgcattgataccctagaacaattagttgagattgttactactatcatatatatttgtggtccgcagcattcggcggttaatttctcccaatatgaatacatgggttttattcctaatatgcccctagctgcttatcaagaaattcaacaaaagggtgatattgaagaccgtcaagccctgatagattttctaccaccagcaaagcccacaaatacccaattatcaactgtgtacatactttcagactatcgttatgacagactgggatattatgaagaggaagaatttacagatccaaatgctgaccaagttgtgaataaatttcagcaagaattgaatgtggtacagagaaaaattgaattgaataataagggacgtttagtaaattacgaatatctccaacccagacttattctcaacagtattagtatttaa

SEQ ID NO: 80 - protein, 548 aa, Anabaena sp. WA102
MQPFLPQNDPNPAQRQSSLEKGRKEYQFMYDFLPPMAMLKSVPPAENFSTKYIAERTLEAAELPLNMMAVKTHAMWDTLDELQDYEDFFPVLQKPNVMKTYETDDSFAEQRLCGVNPMVLRQIKQMPANFAFTIEELQDKFGNSINLIERLATGNLYVADYRSLAFIQGGTYAKGKKYLPAPLAFFCWRSSGFQDRGQLVPVAIQINPKAGKVSPLLTPFDDPLTWFYAKSCVQIADGNHHEMSSHLCRTHLVMEPFAVVTPRQLAENHPLRILLKPHFRFMLANNDLARKRLVSRGGFVDELLAGTLQESLQIVVDAYKSWSLDQFALPRELKNRGVDDVKNLPHYPYRDDGILLWNAINKFVFNYLQLYYKSPADLKADGELQAWARELVAQDGGRVKGMSDRIDTLEQLVEIVTTIIYICGPQHSAVNFSQYEYMGFIPNMPLAAYQEIQQKGDIEDRQALIDFLPPAKPTNTQLSTVYILSDYRYDRLGYYEEEEFTDPNADQVVNKFQQELNVVQRKIELNNKGRLVNYEYLQPRLILNSISI

SEQ ID NO: 81 - DNA, 1659 bp, Dolichospermum circinale
  CDS (1)..(1659)
atgatcaatattatgcagccatttctacctcaaaatgacccgaaccccgcacaacgccaatcttgtctagagaaaggccgcaaagagtatcaattcatgtatgattttttgccgcctatggcgatgctcaaaagcgtacctcccgcagagaatttttctactaagtatattgctgaacggacattagaggcagcagaacttcctctaaatatgatggctgttaaaactcatgctatgtgggatcctttagatgaattgcaagattatgaggactttttcccagttttgcaaaaacctaatgtgatgaaaacctatgaaaccgatgattccttcgccgaacaacggctttgtggagtaaatccgatggttttacgtcaaattaagcaaatgccagctaactttgcctttaccattgaagaattacaggataagtttggcagttctattaatttaattgaaagattggcaaccggaaatctatatgtcgctgattatagatccttggcgttcattcaaggtggcacttatgccaaaggaaaaaagtacctaccagcacctctagcttttttctgttggcgcacttcaggctttcaagatcgaggccaattagtacctgtagccattcaaatcgcccccaaagcaggtaaagtcagccccttgctaactccttttgatgaccctttaacctggttttatgctaagtcctgtgtgcaaattgctgatgctaatcatcatgaaatgagcagccatttatgccggactcacctggtaatggaaccctttgctgttgtcaccccccgtcaactggctgaaaatcatcctctgagaatattactcaaaccccatttccggtttatgttggctaataatgatttagctcgcaagcgtctggttagtaggggcggttttgtggatgaattattagcaggaactctgcaagaatcattgcaaattgtggtagatgcctataaaagttggagtctagaccagtttgctctacccagagaactcaaaaatcgcggtgtgaatgatgtcaaaaacttaccacattatccttatcgggatgatggaattttgttatggaatgcgattaataagtttgtatttaactatttgcagctttattatcagagttcagcagacttgaaagcagacgcagaactgcaagcttgggcgcgggaattagtggctcaggatggtggtagagttaagggtatgagcgatcgcattgataccctagaacaattagtggagattgttactactatcatatatatttgtggtccgcagcattcggcggttaatttctcccaatatgaatacatgggttttattcctaatatgcccctagctgcttatcaaccaattcaacaaaagggtgatattaaagaccgtaaagccctcatagattttctaccaccagccaagcccacaaatacccaattatcaactgtgtacatactttcagactatcgttatgacagactgggatattatgaagaggaagaatttacagatccaaatgctgaccaagttgtgaataaatttcagcaagaattgaatatggtacagagaaaaattgaattgaataataagggacgtttagtaaattacgaatatctccaaccaagacttattctcaacagtattagtatttaa

SEQ ID NO: 82 - protein, 552 aa, Dolichospermum circinale
MINIMQPFLPQNDPNPAQRQSCLEKGRKEYQFMYDFLPPMAMLKSVPPAENFSTKYIAERTLEAAELPLNMMAVKTHAMWDPLDELQDYEDFFPVLQKPNVMKTYETDDSFAEQRLCGVNPMVLRQIKQMPANFAFTIEELQDKFGSSINLIERLATGNLYVADYRSLAFIQGGTYAKGKKYLPAPLAFFCWRTSGFQDRGQLVPVAIQIAPKAGKVSPLLTPFDDPLTWFYAKSCVQIADANHHEMSSHLCRTHLVMEPFAVVTPRQLAENHPLRILLKPHFRFMLANNDLARKRLVSRGGFVDELLAGTLQESLQIVVDAYKSWSLDQFALPRELKNRGVNDVKNLPHYPYRDDGILLWNAINKFVFNYLQLYYQSSADLKADAELQAWARELVAQDGGRVKGMSDRIDTLEQLVEIVTTIIYICGPQHSAVNFSQYEYMGFIPNMPLAAYQPIQQKGDIKDRKALIDFLPPAKPTNTQLSTVYILSDYRYDRLGYYEEEEFTDPNADQVVNKFQQELNMVQRKIELNNKGRLVNYEYLQPRLILNSISI

SEQ ID NO: 83 - DNA, 1647 bp, Anabaena sp. CRKS33
  CDS (1)..(1647)
atgaagccattcctacctcaaaatgacccgaaccccggacaacgccaatcttctctagagaaaggccgcaaagagtatcaattcatgtatgattttttgcctcctatggcgatgctcaaaagcgtacctccggcagagaatttttctactaagtatattgctgaacggacattagaggtagcagaacttcctctgaatatgatggctgttaaaactcatgctatgtgggatcctttagatgaattgcaagattatgaggactttttcccagttttgcagaaacctaatgtgatgaaaacctatgaaactgatgattcctttgccgaacaacggctttgtggggtaaatccgatggttttacgtcaaattaagcaaatgccagctaactttgcctttaccatcgaagaattacaggataagtttggcaattctattaatttaatcgaaagactggcaacgggaaatctatatgtcgctgattatagatccttggcgttcgttcaaggtggcacttatgccaaagggaaaaagtacctaccagcacctctagcttttttctgttggcgcagttcaggctttcaagatcgaggccaattagtccctgtagccattcaaatcaatcccaaggcaggtaaggtcagccccttgctaactccttttgatgatcctttaacctggttttatgctaagtcctgtgtacaaattgctgatgctaatcatcatgaaatgagtagccatttatgccggactcacctggtaatggaaccctttgctgttgtcaccccgcgtcaactggctgaaaatcatcctctgagaatattactcaaaccccatttccggtttatgttggctaataatgatttagctcgcaagcgtctggttagtcggggcggttttgtggatgaattattagcaggaactctgcaagaatcattgcaaattgtggtagatgcctataaaagttggagtctagaccagtttgctctacccagagaactcaaaaatcgcggtgtagatgatgtgaaaaacttgccacattatccttatcgggatgatggaattttgttatggaatgcgattaataagtttgtatttaactatttgcagctttattatcgaagttcagcagacttgaaagcagacggagaactgcaagcttgggcgcgggaattggtggctcaggatggtggtagagttaagggtatgagcgatcgcattgataccttagaacaattagtggagattgttactactatcatatatatttgtggtcctcagcattcggcggttaatttctcccaatatgaatacatgggttttattcctaatatgcccctagctgcttatcaagcaattcaacaaaagggtgatattaaagaccgtcaagccctgatagattttctaccaccagcaaagcccacaaatacccaattatcaactgtgtacatactttcagactatcgttatgacagactgggatattatgaagaggaagaatttacagatccaaatgctgaccaagttgtgaataaatttcagcaagaattgaatgtggtacagagaaaaattgaattgaataataagggacgtttagtaaattatgaatatctccaaccaagacttattctcaacagtattagtatttaa

SEQ ID NO: 84 - protein, 548 aa, Anabaena sp. CRKS33
MKPFLPQNDPNPGQRQSSLEKGRKEYQFMYDFLPPMAMLKSVPPAENFSTKYIAERTLEVAELPLNMMAVKTHAMWDPLDELQDYEDFFPVLQKPNVMKTYETDDSFAEQRLCGVNPMVLRQIKQMPANFAFTIEELQDKFGNSINLIERLATGNLYVADYRSLAFVQGGTYAKGKKYLPAPLAFFCWRSSGFQDRGQLVPVAIQINPKAGKVSPLLTPFDDPLTWFYAKSCVQIADANHHEMSSHLCRTHLVMEPFAVVTPRQLAENHPLRILLKPHFRFMLANNDLARKRLVSRGGFVDELLAGTLQESLQIVVDAYKSWSLDQFALPRELKNRGVDDVKNLPHYPYRDDGILLWNAINKFVFNYLQLYYRSSADLKADGELQAWARELVAQDGGRVKGMSDRIDTLEQLVEIVTTIIYICGPQHSAVNFSQYEYMGFIPNMPLAAYQAIQQKGDIKDRQALIDFLPPAKPTNTQLSTVYILSDYRYDRLGYYEEEEFTDPNADQVVNKFQQELNVVQRKIELNNKGRLVNYEYLQPRLILNSISI

SEQ ID NO: 85 - DNA, 1647 bp, Anabaena sp. LE011-02
  CDS (1)..(1647)
atgcagccatttctacctcaaaatgacccgaaccccgcacaacgccaatcttgtctagagaaaggccgcaaagagtatcaattcatgtatgattttttgcctcctatggcgatgctcaaaagcgtacctcccgcagagaatttctctactaagtatattgctgaacggacattagaggcagcagaacttcctctgaatatgatggctgttaaaactcatgctatgtgggatcctttagatgaattgcaagattatgaggactttttcccaattttgcaaaaacctaatgtgatgaaaacctatgaaaccgatgattctttcgcggaacaacggctttgtggggtaaatccgatggttttacgtcaaattaagcaaatgccagctaactttgcctttaccatcgaagaattacaggctaagtttggcaattctattaatttaatcgaaagattggcaacaggaaatctatatgtcgctgattatagatccttggcgttcgttcaaggtggcacttatgccaaaggaaaaaagtacctaccagcacctctagcctttttctgttggcgcagttcaggctttcaagatcgaggccaattagtccctgtagccattcaaatcaatcccaaggcaggtaaagccagccccttgctaactccttttgatgaccctttaacctggttttatgctaagtcctgtgtgcaaattgctgatggtaatcatcatgaaatgagcagccatttatgccggactcactttgtcatggaaccctttgcggttgttacccctcgtcaactggctgaaaatcatcctctgagaatattactcaaaccccatttccggttcatgttggctaacaatgatttaggtcgtcagcggctggtgaataggggcggtattgttgatgaattattagcaggaactctgcaagaatcattgcaaattgtggtagatgcctataaaagttggagtctggaccagtttgctctacccagagaactcaaaaatcgcggtgtagatgatgtgaaaaacttgccacattatccttatcgggatgatggaattttgttatggaatgcgattaataagtttgtatttaactatttgcaactttattacaagagtccagcagacttgaaagcagacggagaactgcaagcttgggcgcgggaattggtggctcaggatggtggtagagttaagggtatgagcgatcgcattgataccttagaacaattagttgagattattactactatcatatatatttgtggtcctcagcattcggcggttaatttctcccaatatgaatacatgggttttattcctaatatgcccctagctgcttatcaagaaattcaacaaaagggtgatattaaagaccgtcaagccctcatagattttctaccaccagcaaagcccacaaatacccaattatcaactgtgtacatactttcagactatcgttatgacagactgggatattatgaagaggaagaatttgcagatccaaatgctgaccaagttgtgaataaatttcagcaagaattgagtgtggtacagagaaaaattgaattgaataataggggacgtttagtaaattacgaatatctccaacccggacttattctcaacagtattagtatttaa

SEQ ID NO: 86 - protein, 548 aa, Anabaena sp. LE011-02
MQPFLPQNDPNPAQRQSCLEKGRKEYQFMYDFLPPMAMLKSVPPAENFSTKYIAERTLEAAELPLNMMAVKTHAMWDPLDELQDYEDFFPILQKPNVMKTYETDDSFAEQRLCGVNPMVLRQIKQMPANFAFTIEELQAKFGNSINLIERLATGNLYVADYRSLAFVQGGTYAKGKKYLPAPLAFFCWRSSGFQDRGQLVPVAIQINPKAGKASPLLTPFDDPLTWFYAKSCVQIADGNHHEMSSHLCRTHFVMEPFAVVTPRQLAENHPLRILLKPHFRFMLANNDLGRQRLVNRGGIVDELLAGTLQESLQIVVDAYKSWSLDQFALPRELKNRGVDDVKNLPHYPYRDDGILLWNAINKFVFNYLQLYYKSPADLKADGELQAWARELVAQDGGRVKGMSDRIDTLEQLVEIITTIIYICGPQHSAVNFSQYEYMGFIPNMPLAAYQEIQQKGDIKDRQALIDFLPPAKPTNTQLSTVYILSDYRYDRLGYYEEEEFADPNADQVVNKFQQELSVVQRKIELNNRGRLVNYEYLQPGLILNSISI

SEQ ID NO: 87 - DNA, 1647 bp, Anabaena sp. AL93
  CDS (1)..(1647)
atgcagccatttctacctcaaaatgacccgaacccggcacaacgccaatcttctctagagaaaggacgcaaagagtatcaattcatgtatgattttttgccgcctatggcgatgctcaaaagcgtacctcccgcagagaatttttctactaagtatattgctgaacggacattagaggcagcagaacttcctctaaatatgatggctgttaaaactcatgctatgtgggatactttagatgaattgcaagattatgaggactttttcccagttttgcaaaaacctaatgtgatgaaaacctatgaaaccgatgattccttcgccgaacaacggctttgtggggtgaatccaatggttttacgtcaaattaagcaaatgccagctaactttgcctttaccatcgaagaattacaggataagtttggcaattctattaatttaatcgaaagattggccacaggaaatctatatgtcgctgattatagatccttggcgttcattcaaggtggcacttatgccaaaggaaaaaagtacctaccagcacctctagcctttttctgttggcgcagttcgggctttcaagatcgaggccaattagtacctgtagccattcaaatcaatcccaaggcaggtaaagtcagccccttgctaactccttttgatgaccctttaacctggttttatgctaagtcctgtgtgcaaattgctgatgctaatcatcatgaaatgaacagccatttatgccggactcacctggtaatggaaccctttgctgttgtcaccccgcgtcaactggctgaaaatcatcctctgagaatattactcagaccccatttccggtttatgttggctaataatgatttagctcgcaagcgtctggttagtaggggcggttttgtggatgaattattagcaggaactctgcaagaatcattgcaaattgtggtagatgcctataaaagttggagtctagaccagtttgctctacctagggaactcaaaaatcgcggtgtagatgatgtgaaaaacttgccacattatccttatcgggatgatggaattttgttatggaatgcgattaataagtttgtatttaactatttgcagctttattataagagttcagcagacttgaaagcagacggagaactgcaagcttgggcgcgggaactagtggctcaggatggtggtagggttaagggtatgagcgatcgcattgataccctagaacaattagttgagattgttactactatcatatatatttgtggtccgcagcattcggcggttaatttctcccaatatgaatacatgggttttattcctaatatgcccctagctgcttatcaagcaattcaacaaaagggtgatattaaagaccgtcaagccctcatagattttctaccacctgccaagcccacaaatacccaattatcaactgtgtacatactttcagactatcgttatgacagactgggatattatgaagaggaagaatttacagatcgaaatgctgaccaagttgtgaataaatttcagcaagaattgaatgtggtacagagaaaaattgaattgaataataagggacgtttagtaaattacgaatatctccaacccagacttattctcaacagtattagtatttaa

SEQ ID NO: 88 - protein, 548 aa, Anabaena sp. AL93
MQPFLPQNDPNPAQRQSSLEKGRKEYQFMYDFLPPMAMLKSVPPAENFSTKYIAERTLEAAELPLNMMAVKTHAMWDTLDELQDYEDFFPVLQKPNVMKTYETDDSFAEQRLCGVNPMVLRQIKQMPANFAFTIEELQDKFGNSINLIERLATGNLYVADYRSLAFIQGGTYAKGKKYLPAPLAFFCWRSSGFQDRGQLVPVAIQINPKAGKVSPLLTPFDDPLTWFYAKSCVQIADANHHEMNSHLCRTHLVMEPFAVVTPRQLAENHPLRILLRPHFRFMLANNDLARKRLVSRGGFVDELLAGTLQESLQIVVDAYKSWSLDQFALPRELKNRGVDDVKNLPHYPYRDDGILLWNAINKFVFNYLQLYYKSSADLKADGELQAWARELVAQDGGRVKGMSDRIDTLEQLVEIVTTIIYICGPQHSAVNFSQYEYMGFIPNMPLAAYQAIQQKGDIKDRQALIDFLPPAKPTNTQLSTVYILSDYRYDRLGYYEEEEFTDRNADQVVNKFQQELNVVQRKIELNNKGRLVNYEYLQPRLILNSISI

SEQ ID NO: 89 - DNA, 1647 bp, Aphanizomenon flos-aquae
  CDS (1)..(1647)
atgcagccatttctacctcaaaatgacccaaacccggcacaacgccaatcttgtctagagaaaggccgcaaagagtataaattcatgtatgattttttgccgcctatggcaatgatcaaaagcgtacctcccgcagagaatttttctactaagtatattgctgaacggacattagaggcggcagaacttcctctaaatatgatggctgttaaaactcatgctatgtgggatcctttagatgaattgcaagattatgaggactttttcccagttttgcaaaaacctaatgtgatgaaaacctatgaaaccgatgattccttcgccgaacaacggctctgtggggtaaatccgatggttttacgtcaaattaagcaaatgccagctaactttgcctttaccatcgaagaattacaggataagtttggcaattctattaatttaatcgaaagattggccacaggaaatctatatgtcgctgattatagatccttggcgttcgttcaaggtggcacttatgccaaagggaaaaagtacctaccagcacctctagcttttttctgttggcgcagttcaggctttcaagatcgaggccaattagtccctgtagccattcaaatcaatcccaaggcaggtaaggtcagccccttgctgactccttttgatgaccctttaacctggttttatgctaagtcctgtgtacaaattgctgatgctaatcatcatgaaatgagtagccatttatgccggactcacctggtaatggaaccctttgctgttgtcaccccgcgtcaactggctgaaaatcatcctctgagaatattactcaaaccccatttccggtttatgttggctaataatgatttagctcgcaagcgtctggttagtcggggcggttttgtggatgaattattagcaggaactctgcaagaatcattgcaaattgtggtagatgcctataaaagttggagtctggaccagtttgctctacccagggaactcaaaaatcgcggtgtagatgatgtgaaaaacttgccacattatccttatcgggatgatggaattttgttatggaatgcgattaataagtttgtatttaactatttgcagctttattacaagagtccagcagacttgaaagcagacggagaactgcaagcttgggcgcgggaattggtggctcaggatggtggtagagttaagggtatgagcgatcgcattgataccttagaacaattagttgagattgttactactatcatatatatttgtggtccgcagcattcggcggttaatttctcccaatatgaatacatgggttttattcctaatatgcccctagctgcttatcaagaaattcaacaaaagggtgatattaaagaccgtcaagccctcatagattttctaccaccagcaaagcccacaaatacccaattatcaactgtgtacatactttcagactatcgttatgacagactgggatattatgaagaggaagaatttacagatccaaatgctgaccaagttgtgaataaatttcagcaagaattgaatgtggtacagagaaaaattgaattgaataataagggacgtttagtaaattatgaatatctccaaccaagacttattctcaacagtattagtatttaa

SEQ ID NO: 90 - protein, 548 aa, Aphanizomenon flos-aquae
MQPFLPQNDPNPAQRQSCLEKGRKEYKFMYDFLPPMAMIKSVPPAENFSTKYIAERTLEAAELPLNMMAVKTHAMWDPLDELQDYEDFFPVLQKPNVMKTYETDDSFAEQRLCGVNPMVLRQIKQMPANFAFTIEELQDKFGNSINLIERLATGNLYVADYRSLAFVQGGTYAKGKKYLPAPLAFFCWRSSGFQDRGQLVPVAIQINPKAGKVSPLLTPFDDPLTWFYAKSCVQIADANHHEMSSHLCRTHLVMEPFAVVTPRQLAENHPLRILLKPHFRFMLANNDLARKRLVSRGGFVDELLAGTLQESLQIVVDAYKSWSLDQFALPRELKNRGVDDVKNLPHYPYRDDGILLWNAINKFVFNYLQLYYKSPADLKADGELQAWARELVAQDGGRVKGMSDRIDTLEQLVEIVTTIIYICGPQHSAVNFSQYEYMGFIPNMPLAAYQEIQQKGDIKDRQALIDFLPPAKPTNTQLSTVYILSDYRYDRLGYYEEEEFTDPNADQVVNKFQQELNVVQRKIELNNKGRLVNYEYLQPRLILNSISI

SEQ ID NO: 91 - DNA, 1647 bp, Anabaena sp. WA113
  CDS (1)..(1647)
atgcagccatttctacctcaaaatgacccaaaccccgcacaacgccaatcttctctagagaaaggccgcaaagagtatcaattcatgtatgattttttgccgcctatggcgatgctcaaaagcgtacctcccgcagagaatttttctactaagtatattgctgaacggacattagaggcagcagaacttcctctaaatatgatggctgttaaaactcatgctatgtgggatcctttagatgaattgcaagattatgaagactttttcccagttttgcaaaaacctaatgtgatgaaaacctatgaaaccgatgattccttcgccgaacaacggctttgtggggtgaatccgatggttttacgtcaaattaagcaaatgccagctaactttgcctttaccattgaagaattacaggataagtttggcaattctattaatttaatcgaaagattggccacaggaaatctatatgtcgctgattatagatccttggcgttcattcaaggtggcacttatgccaaaggaaaaaagtacctaccagcacctctggcctttttctgttggcgcagttcgggctttcaagatcgaggccaattagtccctgtagccattcaaatcaatcccaaagcaggtaaagccagccccttgctgactccttttgatgaccctttaacctggttttatgctaagtcctgtgtgcaaattgctgatggtaatcatcatgaaatgagtagccatttatgtcggactcacttagtaatggaaccctttgctgttgtcaccccgcgtcaactggctgaaaatcatcctctgagaatattactcagaccccatttccggtttatgttggctaataatgatttagcccgcaagcgtctggttagtaggggcggttttgttgatgaattattagcaggaactctgcaagaatcattgcaaattgtggtagatgcctataaaagttggagtctggaccagtttgctctacccagggaactcaaaaatcgcggtgtagatgatgtgaaaaacttgccacattatccttatcgggatgatggaattttgttatggaatgcgattaataagtttgtatttaactatttgcaactttattacaagagtccagcagacttgaaagcagacggagaactacaagcttgggcgcgggaattggtggctcaggatggtggtagagttaagggtatgagcgatcgcattgataccttagaacaattagttgagattgttactactatcatatatatttgtggtccgcagcattcggcggttaatttctcccaatatgaatacatgggttttattcctaatatgcccctagctgcttatcaagcaattcaagaaaagggtgatattaaagaccgtcaagccctcatagattttctaccacttgccaaacccacaaatacccaattatcaactgtgtacatactttcagactatcgttatgacagactgggatattatgaagaggaagaatttacagatccaaatgctgaccaagttgtgaataaatttcagcaagaattgagtgtggtacagagaaaaattgaattgaataataagggacgtttagtaaattacgaatatctccaacccagacttattctcaacagtattagtatttaa

SEQ ID NO: 92 - protein, 548 aa, Anabaena sp. WA113
MQPFLPQNDPNPAQRQSSLEKGRKEYQFMYDFLPPMAMLKSVPPAENFSTKYIAERTLEAAELPLNMMAVKTHAMWDPLDELQDYEDFFPVLQKPNVMKTYETDDSFAEQRLCGVNPMVLRQIKQMPANFAFTIEELQDKFGNSINLIERLATGNLYVADYRSLAFIQGGTYAKGKKYLPAPLAFFCWRSSGFQDRGQLVPVAIQINPKAGKASPLLTPFDDPLTWFYAKSCVQIADGNHHEMSSHLCRTHLVMEPFAVVTPRQLAENHPLRILLRPHFRFMLANNDLARKRLVSRGGFVDELLAGTLQESLQIVVDAYKSWSLDQFALPRELKNRGVDDVKNLPHYPYRDDGILLWNAINKFVFNYLQLYYKSPADLKADGELQAWARELVAQDGGRVKGMSDRIDTLEQLVEIVTTIIYICGPQHSAVNFSQYEYMGFIPNMPLAAYQAIQEKGDIKDRQALIDFLPLAKPTNTQLSTVYILSDYRYDRLGYYEEEEFTDPNADQVVNKFQQELSVVQRKIELNNKGRLVNYEYLQPRLILNSISI

SEQ ID NO: 93 - DNA, 1647 bp, Anabaena sp. 90
  CDS (1)..(1647)
atgcagccatttctacctcaaaatgacccgaaccccgcacaacgccaatcttgtctagagaaaggccgcaaagagtatcaattcatgtatgattttttgccgcctatggcgatgctcaaaagcgtacctcccgcagagaatttttctactaagtatattgctgaacggacattagaggcagcagaacttcctctaaatatgatggctgttaaaactcatgctatgtgggatcctttagatgaattgcaagattatgaggactttttcccagttttgcaaaaacctaatgtgatgaaaacctatgaaaccgatgattccttcgccgaacaacggctttgtggggtgaatccgatggttttacgtcaaattaagcaaatgccagctaactttgcctttaccattgaagaattacaggataagtttggcaattctattaatttaatcgaaagattggccacaggaaatctatatgtcgctgattatagatccttggcgttcgttcaaggtggcacttatgccaaaggaaaaaagtacctaccagcacctctggcctttttctgttggcgcagttcgggctttcaagatcgaggccaattagtccctgtagccattcaaatcaatcccaaagcaggtaaagccagccccttgctaactccttttgatgaccctttaacctggttttatgctaagtcctgtgtgcaaattgctgatgctaatcatcatgaaatgagcagccatttatgccggactcacctggtaatggaaccctttgctgttgtcaccccgcgtcaactggctgaaaatcatcctctgagaatattactcagaccccatttccggtttatgttggctaataatgatttagctcgcaagcgtctggttagtaggggcggttttgtggatgaattattagcaggaactctgcaagaatcattgcaaattgtggtagatgcctataaaagttggagtctagaccagtttgctctacctagggaactcaaaaatcgcggtgtagatgatgtgaaaaacttgccacattatccttatcgggatgatggaattttgttatggaatgcgattaataagtttgtatttaactatttgcagctttattataagagtccagcagacttgaaagcagacggagaactgcaagcttgggcgcgggaattagtggctcaggatggtggtagggttaagggtatgagcgatcgcattgataccctagaacaattagttgagattgttactactatcatatatatttgtggtccgcagcattcggcagttaatttctcccaatatgaatacatgggttttattcctaatatgcccctagctgcttatcaagaaattcaacaaaagggtgatattgaagaccgtcaagccctcatagattttctaccacctgccaaacccacaaatacccaattatcaactgtgtacatactttcagactatcgttatgacagactgggatattatgaagaggaagaatttgcagatccaaatgctgacaaagttgtgaataaattccagcaagaattgagtgtggtacagagaaaaattgaattgaataataagggacgtttagtaaattatgaatatctccaaccaagactcattctcaacagtattagtatttaa

SEQ ID NO: 94 - protein, 548 aa, Anabaena sp. 90
MQPFLPQNDPNPAQRQSCLEKGRKEYQFMYDFLPPMAMLKSVPPAENFSTKYIAERTLEAAELPLNMMAVKTHAMWDPLDELQDYEDFFPVLQKPNVMKTYETDDSFAEQRLCGVNPMVLRQIKQMPANFAFTIEELQDKFGNSINLIERLATGNLYVADYRSLAFVQGGTYAKGKKYLPAPLAFFCWRSSGFQDRGQLVPVAIQINPKAGKASPLLTPFDDPLTWFYAKSCVQIADANHHEMSSHLCRTHLVMEPFAVVTPRQLAENHPLRILLRPHFRFMLANNDLARKRLVSRGGFVDELLAGTLQESLQIVVDAYKSWSLDQFALPRELKNRGVDDVKNLPHYPYRDDGILLWNAINKFVFNYLQLYYKSPADLKADGELQAWARELVAQDGGRVKGMSDRIDTLEQLVEIVTTIIYICGPQHSAVNFSQYEYMGFIPNMPLAAYQEIQQKGDIEDRQALIDFLPPAKPTNTQLSTVYILSDYRYDRLGYYEEEEFADPNADKVVNKFQQELSVVQRKIELNNKGRLVNYEYLQPRLILNSISI

SEQ ID NO: 95 - DNA, 1644 bp, Aphanizomenon flos-aquae
  CDS (1)..(1644)
atgaagccatttttacctcaaaatgacccaaatcccacacaacgacaatcttccctagagaaaggtcgcaaagagtatgaatttaggtatgattttttgcctcctatggcgatgctcaaaaacgtacctccctctgagaatttttctaccaagtatattgctgaacggacaatagagacagcagaacttcctagcaatatgatggctgtcaaagcccatgctatgtgggaccccttagatgaattgcaagactatgaagacttttttccagttttgcaaaaacctaatgtgatgaaaaattatgaaacagatgattccttcgccgaacaacggctttgtggcgtgaatcctgtggttttacggcagattaagcaaatgcccgtcaactttgcctttaccatcgaagaattgcaagctaagtttggcaactctattgatttaagagaaagactggcaaccggaaatctctatgtagctgattatagacctttggcgttcattcgaggtggcacttttgccaaagggaaaaagtatttaccagcaccactagcctttttctgttggcggagttcaggctttcaagatcgtggtcaattagtacctatagcgattcaaatcaatcctaaggaaggaaaagccagccccttgctgaccccttttgatgactcttctacctggttttatgccaagtcctgtgtgcaaattgctgatgctaatcatcatgaaatgagtagccatttatgccggactcactttgtaatggaaccttttgctgttgttacccctcgtcaattagcccagaaccatccgctgagaatattactaaaaccccatttccggttcatgttggctaacaatgatttaggtcgtcagcggttggtgaatagaggcggtcctgttgatgaattattagcgggaactctgcaagaatcactgcaaattgttctagacgcttatacagattggagattggatcagtttgcgctaccaacagaactcaaaaatcgcggtgtggatgatgtgaaaaatttgccccactatccttatcgggacgatgggatcttgttgtggaacgcgattaacaagtttgtgtttaactatttggagctttactacaagagtcccgcagacttgacagcagatgtcgaactacaagcttgggcgcgggaattagtggctcaggatggtggtagagtcaaggggatgagcgatcgcattgatactttgaaacaattagtagagattgttactactatcatttacacttgtggacccctgcattctgctgttaatttcccccaatatgaatacatgggtttcattcccaatatgcctctggctgcttatcaaccaattaaaaaagaaggggtttgtacccgcaaggaactgatagattttttaccagctgccaaaccaacaagtagccaattaacaactgtattcacactctcagcctatcgttatgacagactaggatattatgaagaggaagaatttgaagaccccaatgctgacgatgttgtgaataaattccagcaagaattgaatgtggtgcaaagaaaaattgagttgagcaacaagggacgtttagtaaattacgaatacctacaacccagacttatcctcaacagcatcagtatttaa

SEQ ID NO: 96 - protein, 547 aa, Aphanizomenon flos-aquae
MKPFLPQNDPNPTQRQSSLEKGRKEYEFRYDFLPPMAMLKNVPPSENFSTKYIAERTIETAELPSNMMAVKAHAMWDPLDELQDYEDFFPVLQKPNVMKNYETDDSFAEQRLCGVNPVVLRQIKQMPVNFAFTIEELQAKFGNSIDLRERLATGNLYVADYRPLAFIRGGTFAKGKKYLPAPLAFFCWRSSGFQDRGQLVPIAIQINPKEGKASPLLTPFDDSSTWFYAKSCVQIADANHHEMSSHLCRTHFVMEPFAVVTPRQLAQNHPLRILLKPHFRFMLANNDLGRQRLVNRGGPVDELLAGTLQESLQIVLDAYTDWRLDQFALPTELKNRGVDDVKNLPHYPYRDDGILLWNAINKFVFNYLELYYKSPADLTADVELQAWARELVAQDGGRVKGMSDRIDTLKQLVEIVTTIIYTCGPLHSAVNFPQYEYMGFIPNMPLAAYQPIKKEGVCTRKELIDFLPAAKPTSSQLTTVFTLSAYRYDRLGYYEEEEFEDPNADDVVNKFQQELNVVQRKIELSNKGRLVNYEYLQPRLILNSISI

SEQ ID NO: 97 - DNA, 1644 bp, Nostoc sp. ATCC 53789
  CDS (1)..(1644)
atgaaaccataccttcctcaaaatgatcctgaccctacaaaacgtaaaatattgctagagagaaaccaaggagagtatgaatttgattacgactttttaacgcctatggcaatgctaaaaaatgtaccttctatagaaaacttttcaactaagtatattgctgaacgcacattagagacagcagaactacctataaatatgttagccgttaaaacccgttctttatgggaccctttagatgaattgcaagactatgaagactattttccagttttgcctaaacctaatgttatcaaaacataccaaactgatgactctttttgtgaacaacggctttgtggggcaaatccttttgttttacgtcgaattgaaaagatgccagatggcttcgcctttaccattttagaactgcaagaaaagtttggtgactctattaacttagttgacaaacttacgaatggaaatttatatgtagctgattatagagcgcttgcgtttgttaaaggaggtacttatgaaagaggtaagaagtatttaccaacccctatagctttcttttgttggcgcagttctggttttagcgatcgcggtcaactagtaccgattgttatccaaatcaaccccacagatggcaaacagagccagctaattacgccttttgatgaccctttaacctggtttcatgccaaactttgtgttcaaattgctgatgctaaccatcatgaaatgagtagtcatctgtgccgaactcactttgttatggaaccctttgctattgtcacagcccgtcaactagccgagaaccatccccttagcttactgctaaaaccccacttccgtttcatgttggctaataatgacttggctcgtaagcgcctaattagtagaggtgggcctgttgacgaattgctagccggaactctgcaagagtcattgcaaattgtcgtcaacgcatatcaagaatggagcttagatcagttttccttacccactgaactaaaaaatcggggtatggatgacccaaacaacctacctcactatccctatcgagacgatggcttgctattgtggaatgcaattaaaaagtttgtgtctgaatacttgcaaatatactacaaaactccccaagacttagcagcagacttagaattacaaagttgggcgcaggaattagtttcccaatcaggcgggcgagttaagggtattagcaatcgcatcgacacattagaccaattagttgatattgctactgcggttattttcacctgtgggccgcaacacgctgctgttaactactcacaatatgaatatatgactttcatgcccaatatgcctcttgctgcttataaacaaatgacatcagaaggcactattcctgaccgtaaaagtctattatcatttctgccaccgtcaaagcaaactgctgaccaattatcgattttatttatcctgtcagcttaccgttatgacagattagggtactatgatgataagtttgtagacccagaggctcaggatgttttagctaaatttcagcaagatttgaacgaagcggagcgggaaattgagttgaataacaagagtcgtttaataaattacaactatctgaaaccacggcttgttactaatagtattagcgtgtaa

SEQ ID NO: 98 - protein, 547 aa, Nostoc sp. ATCC 53789
MKPYLPQNDPDPTKRKILLERNQGEYEFDYDFLTPMAMLKNVPSIENFSTKYIAERTLETAELPINMLAVKTRSLWDPLDELQDYEDYFPVLPKPNVIKTYQTDDSFCEQRLCGANPFVLRRIEKMPDGFAFTILELQEKFGDSINLVDKLTNGNLYVADYRALAFVKGGTYERGKKYLPTPIAFFCWRSSGFSDRGQLVPIVIQINPTDGKQSQLITPFDDPLTWFHAKLCVQIADANHHEMSSHLCRTHFVMEPFAIVTARQLAENHPLSLLLKPHFRFMLANNDLARKRLISRGGPVDELLAGTLQESLQIVVNAYQEWSLDQFSLPTELKNRGMDDPNNLPHYPYRDDGLLLWNAIKKFVSEYLQIYYKTPQDLAADLELQSWAQELVSQSGGRVKGISNRIDTLDQLVDIATAVIFTCGPQHAAVNYSQYEYMTFMPNMPLAAYKQMTSEGTIPDRKSLLSFLPPSKQTADQLSILFILSAYRYDRLGYYDDKFVDPEAQDVLAKFQQDLNEAEREIELNNKSRLINYNYLKPRLVTNSISV

SEQ ID NO: 99 - DNA, 1644 bp, Nostoc linckia
  CDS (1)..(1644)
atgaaaccataccttcctcaaaatgaccccgacccaacaaaacgcaaatctttcttagagcgtaagcaagaagaatatgaattcgattatgattttttaccgccgatggcgatgcttaaagatgtacctgccgtcgaaaatttttctacaaaatatattgctgaacgtgcagtagaaacggcagagcttcctatcaatatgttggctgttaaaacccatactttatgggaccctttggatgaattgcaagactatgaagactattttccagtcttgcctaaacctactgtcatcaaaacataccaaactgatgactcgttttgcgaacaacggctgtgtgggtcaaatcctatggctttacgccaaattaaagagatgcctttagactttgagtttactattcaagaattacaacgaaaatttggcgaatctatcaatttggcagaaaaacttgccaatggaaatttatatataaccgattacagatcgctttcctttgttaaaggaggcacttacgaaagaggtagaaagtatttaccaacacccttagcttttttttgttggcgtagttctggctttagcgatcgcggtcaacttgtacctattgccattcaactcaatcccgcagccggtaaacaaagccaactaatcacaccttttgacgatcctttagcttggtttcatgccaaactatgcgttcaaatcgctgatgctaaccatcatgaaatgagtagccatctttgtcgaactcactttgttatggaacctttcgccattgtcacagcccgtcaattagctgataatcatcctcttaatttattactaaaaccgcacttccgtttcatgttggctaataatgatttgggtcgcaagcgcttagttaataggggcggccctgttgatgaattgctagctggaactctgcaagaatcactacaaattgttgttaatgcctataaagaatggagcttagataagtttgccttacccacggaaatcaaaaatcgtggtgtagacgatccacaaaaattacctcactatccctatcgagatgatgggatgctattgtggaatgccattaaaaagtttgtgtctgaatacttgaatttatactacaaaactcccgaagatttgacagcagactttgaattacaagcttgggcgcaggaactagtttctcaatcaggcggacgagttaaaggcgttcccgatcgcattgaaaaattagaacaattaattgatatcgctactgcggtaattttcacttgcgggccgcaacacgctgctgtgaactatccacaatatgaatatatgactttcatgccgaatatgccccttgctggttataaacaaatgacatcagaaggcactattgctgaccgcaaaagtctattatcatttctgccaccaccgaagcaaactgctgaccaattgtcaattttattcatcctctcagcttaccgttatgacagattaggctactatgacgataagtttgcagacccagaagctgaggatattgtagctacatttcagcaagatttgaacgaggtagatcgagaaattgagttgaataataagagccgtttaataaagtataactatctcaaaccaaggcttgttaccaatagtattggcatctaa

SEQ ID NO: 100 - protein, 547 aa, Nostoc linckia
MKPYLPQNDPDPTKRKSFLERKQEEYEFDYDFLPPMAMLKDVPAVENFSTKYIAERAVETAELPINMLAVKTHTLWDPLDELQDYEDYFPVLPKPTVIKTYQTDDSFCEQRLCGSNPMALRQIKEMPLDFEFTIQELQRKFGESINLAEKLANGNLYITDYRSLSFVKGGTYERGRKYLPTPLAFFCWRSSGFSDRGQLVPIAIQLNPAAGKQSQLITPFDDPLAWFHAKLCVQIADANHHEMSSHLCRTHFVMEPFAIVTARQLADNHPLNLLLKPHFRFMLANNDLGRKRLVNRGGPVDELLAGTLQESLQIVVNAYKEWSLDKFALPTEIKNRGVDDPQKLPHYPYRDDGMLLWNAIKKFVSEYLNLYYKTPEDLTADFELQAWAQELVSQSGGRVKGVPDRIEKLEQLIDIATAVIFTCGPQHAAVNYPQYEYMTFMPNMPLAGYKQMTSEGTIADRKSLLSFLPPPKQTADQLSILFILSAYRYDRLGYYDDKFADPEAEDIVATFQQDLNEVDREIELNNKSRLIKYNYLKPRLVTNSIGI

SEQ ID NO: 101 - DNA, 1644 bp, Nostoc sp. ATCC 43529
  CDS (1)..(1644)
atgaatccataccttcctcaaaatgatcctgacccaacaaaacgcaagttttctttagagcgtaagctagaagaatacgaattcgattacaactttttaccgccgatggcgatgcttaaagatgtacctgccgtggaaaatttttctaccaagtatattgctgaacgtgcagtagaaacggcagaacttcctctcaacatgttggctgttaaaacccgtagtttatgggaccctttggatgaattgcaagactatgaagattattttccagtcttgcctaaacctgatgtcatcaaaacataccaaactgatgactcgttttgcgagcaacggttgtgtggggcaaatcctatggctttacgccaaattaaagagatgcctttaggctttgagtttactattcaagaattgcaagaaaagtttggggaatctatcaatttggcagaaaaacttgccaatggaaatttatatataactgattatagaccactttcatttgttaaaggaggcacttacgaaagaggtaaaaagtatttaccaacaccgttagcttttttctgttggcgtagttctggttttagcgatcgcggtcaacttgtacctattgccattcaactcaatcccgcactcggcaaacaaagtcaattaatcacaccttttgacgatcctttgacttggtttcatgctaaactatgcgttcaaatcgctgatgctaaccatcatgaaatgagtagccatctttgtcgaactcactttgttatggaacctttcgccattgttacagctcggcaattagctgataatcaccctcttaacatattactaaaaccccacttccgtttcatgttggctaataatgacttgggtcgcaagcgcttagttaataggggcggtcctgttgatgaattgctagctggaactctgcaagaatcattacaaattgttgtcaatgcctataaagaatggagtttagatcaatttgccttacccacggaaatcaaaaatcgtggtgtggataatccagacaacttgcctcactatccctatcgagatgatgggatgctcttgtggaatgccattaaaaagttcgtgtctgaatatttgaagttatactacaaaactcccgaagatttgacagcagactttgaattgcaagcttgggcacaggaactagtttctcaatcaggcggacgagttaaaggcgttccttcgcgcattgaaaaattagaacaattagttgacattactactgcggtaattttcacttgtgggccgcaacacgctgctgttaactatccacaatatgaatatatgaccttcatgccgaatatgccccttgctggttataaacaaatgacatcagaaggcactattcctgaccgcaaaagcctattatcatttctgccaccccctaagcaaactgctgaccaattgtcaattttattcatcctctcagcttaccgttatgacagattaggctattatgacgataaatttgcagactcagaagctgagcaaattttagttacattccaccaagatttgaccgaggtagagcgagaaattgaattgaataacaagagccgtttaatcaagtatgactatctcaaaccaaggcttgtaaccaatagcatcagcatctaa

SEQ ID NO: 102 - protein, 547 aa, Nostoc sp. ATCC 43529
MNPYLPQNDPDPTKRKFSLERKLEEYEFDYNFLPPMAMLKDVPAVENFSTKYIAERAVETAELPLNMLAVKTRSLWDPLDELQDYEDYFPVLPKPDVIKTYQTDDSFCEQRLCGANPMALRQIKEMPLGFEFTIQELQEKFGESINLAEKLANGNLYITDYRPLSFVKGGTYERGKKYLPTPLAFFCWRSSGFSDRGQLVPIAIQLNPALGKQSQLITPFDDPLTWFHAKLCVQIADANHHEMSSHLCRTHFVMEPFAIVTARQLADNHPLNILLKPHFRFMLANNDLGRKRLVNRGGPVDELLAGTLQESLQIVVNAYKEWSLDQFALPTEIKNRGVDNPDNLPHYPYRDDGMLLWNAIKKFVSEYLKLYYKTPEDLTADFELQAWAQELVSQSGGRVKGVPSRIEKLEQLVDITTAVIFTCGPQHAAVNYPQYEYMTFMPNMPLAGYKQMTSEGTIPDRKSLLSFLPPPKQTADQLSILFILSAYRYDRLGYYDDKFADSEAEQILVTFHQDLTEVEREIELNNKSRLIKYDYLKPRLVTNSISI

SEQ ID NO: 103 - DNA, 1641 bp, Mastigocladopsis repens
  CDS (1)..(1641)
atgaaacccaacttaccgcaacacgagccaaatcccgaagctcggagaaattggctagaacaaaaccgagaagattataaattcgaccataattatctggctcccataccaatacttgataaggtgcctcatcaagaactcttctcgccgaaatatactgctaaacgcttagcaagtatggcgaatctcgtacctaatatgcttgctgccaaagccagaaatttcttcgatccgctggatgaattagaagaatatgaagaccttttgccgatattaccaaagccctctgtcataaaaaattataaaacagactcgtgtttcgccgagcaaagactctctggggcaaacccgatggcaatgcacaggattgacgcgctcccggaaaatttccctgtcacaaacgaccactttcaaaaagccgtaggtgcagctcacgatctggaggcggcactcaaagaaggcaaactctatttattagattatcctttgctatttgacattaaaggcggtacctaccaaaacattaaaaagtatcttcccaagccgcaggctctattttactggcaaagcaatggcaataaaaatagtggttctctgatgcctattgccattcagctccataatgatactgacggagatagcctaatttacacaccagatgacccccatttagattggtttttggcaaaaacttgcgtacaaatggctgatgggaaccatcaggaattgggcagtcattttgcacgaactcatgcagttatgggtccgtttgcagtcgtcacggctcgacaactcggagaaaaccatcccctctccttactcctgagaccccacttccggttcatgctctatgataacgatttggggcgtactcactttttacaaccaggaggtccagttgatgaatttatggcaggtacgttgcaggagtctcttggtttcgttggcaaagcctacgaagaatggagtttagacaatgctgtcttcgcgacggaaataaaaaatcgcaaaatggatgatccagaaattttgccgcactatcctttccgggatgacgggatgttagtctgggatgcggtcaaaaagtttgtcactgaatacatccaactctattacaaaactccccaagacttgagtgaggattatgaattgcaaaattgggcgagagaattggctgcccaagatggtggtcgtgttaaggggatgccagagaaaattgagaccatagagcaactcattgacattgtgactgtagtcgtcttcacctgcgctcctctccactcggctttgaatttttcccagtacgaatacatggcttttgtacccaatatgccgtatgcagcctaccaccctgttccagaaacaaagggtgtggatatgcaaacgatcatgaagatgcttccaccctttaagcacgctgccgatcaggtgatgtggtcggatattttgacatccttccattacgacaaattgggtcactatgatgaagaatttgccgacccaattgctcaggaaattcttgtgcagtttcaacaaaatttacatgaagtggaacgacaaatagaaattaaaaaccaatctcgtccaataccttataactacctcaagccttctgaaattattaatagcatcaatacttga

SEQ ID NO: 104 - protein, 546 aa, Mastigocladopsis repens
MKPNLPQHEPNPEARRNWLEQNREDYKFDHNYLAPIPILDKVPHQELFSPKYTAKRLASMANLVPNMLAAKARNFFDPLDELEEYEDLLPILPKPSVIKNYKTDSCFAEQRLSGANPMAMHRIDALPENFPVTNDHFQKAVGAAHDLEAALKEGKLYLLDYPLLFDIKGGTYQNIKKYLPKPQALFYWQSNGNKNSGSLMPIAIQLHNDTDGDSLIYTPDDPHLDWFLAKTCVQMADGNHQELGSHFARTHAVMGPFAVVTARQLGENHPLSLLLRPHFRFMLYDNDLGRTHFLQPGGPVDEFMAGTLQESLGFVGKAYEEWSLDNAVFATEIKNRKMDDPEILPHYPFRDDGMLVWDAVKKFVTEYIQLYYKTPQDLSEDYELQNWARELAAQDGGRVKGMPEKIETIEQLIDIVTVVVFTCAPLHSALNFSQYEYMAFVPNMPYAAYHPVPETKGVDMQTIMKMLPPFKHAADQVMWSDILTSFHYDKLGHYDEEFADPIAQEILVQFQQNLHEVERQIEIKNQSRPIPYNYLKPSEIINSINT

SEQ ID NO: 105 - DNA, 1635 bp, Aliterella atlantica
  CDS (1)..(1635)
atgataaaaccatatttacctcaacacgagcctgatgcgatcgcgcggcaaaatcgcttaatcaaaaaccgcgctgattatgttctcgactataactatctgccacctattcctttgcaaactcctgttcctcaacaagaacgtttttctgctgaatacactgcaaggcgtttagctagttttgctaatctcgtccccaatatgttgatggcgagggcgagaaatgctttcgatcctttagatacgttagaggaatacgcggacttattaccagtcttaccaaaacctaatgtcatcaaaaattatcaagcagattggtgttttgccgaacaaagattatctggtattaacccgccagctatccgccgcatagatgctttgccagaaaatttgcccatctctaactcttcgtttcaacactctgtaggtgcagaacataatctggaacaagcactcaaagaaggtaagttgtattgtttagactacccgttgttatctggtattggaggcggtaattaccagaatttacctaaatatctgcccaaaccgcaagcgctcttttattggcgtagtgataatagcaaaatcggcggctctttagttccggtagcgattaaaattctcaatgaattgggagggaaaaatttagtctatacgcccaatgatgcacctctcgactggtttcttgccaaaacctgcgtgcaaatggcagatgcaaaccatcaggaattaggcactcattttgctaaaactcatgctgttatggctcctattgcggcaattacagctagggaattaggcgaaaaccatcctttaactttgctgctaaaacctcatttccggttcatgctgtttgataatgagttaggacgcacgcagtttttgcaacctactggtcctactgaagaactgctagctggaacgctggaagaatctgtgcaattggtcgtgcaagcttatgaggaatggagtatagatactacttttcctttagaattgcagcaacggcaaatgcatgacccagagattttacctcattacccgttccgagatgatggcatattagtctggaatgctatacatcagtttgttactgaatatttgcagatttactaccacactccgcaagatatcagtgcagactacgaggtgcaaaattgggctagggaattggtagatagcggtcgagttaaaggaatgccagagagcattgatactctagcacaactaattgacattatcgctgtagtcatctttacctgcgctcctctgcattcttgcttgaatttagcccagtacgaatacatgactttcgtgccaaatatgccttatgcagcctaccaccctattcccactactaagggcgtagatatggcaactattgtcaaaattatgccgccttttcaaagagcgatcgatcaaatattgtggacggatattttgagcgctttccaatatgacaagttgggtttttatgaggaagattttgccgatcccaaggctcaggaagtgctacagcgctttcaagataacttgcagcaggtagaagaaaagatagaaatgcacaatcagattcgcccaataccttacaactacctcaagccttctcggattatgaacagcattaatacttaa

SEQ ID NO: 106 - protein, 544 aa, Aliterella atlantica
MIKPYLPQHEPDAIARQNRLIKNRADYVLDYNYLPPIPLQTPVPQQERFSAEYTARRLASFANLVPNMLMARARNAFDPLDTLEEYADLLPVLPKPNVIKNYQADWCFAEQRLSGINPPAIRRIDALPENLPISNSSFQHSVGAEHNLEQALKEGKLYCLDYPLLSGIGGGNYQNLPKYLPKPQALFYWRSDNSKIGGSLVPVAIKILNELGGKNLVYTPNDAPLDWFLAKTCVQMADANHQELGTHFAKTHAVMAPIAAITARELGENHPLTLLLKPHFRFMLFDNELGRTQFLQPTGPTEELLAGTLEESVQLVVQAYEEWSIDTTFPLELQQRQMHDPEILPHYPFRDDGILVWNAIHQFVTEYLQIYYHTPQDISADYEVQNWARELVDSGRVKGMPESIDTLAQLIDIIAVVIFTCAPLHSCLNLAQYEYMTFVPNMPYAAYHPIPTTKGVDMATIVKIMPPFQRAIDQILWTDILSAFQYDKLGFYEEDFADPKAQEVLQRFQDNLQQVEEKIEMHNQIRPIPYNYLKPSRIMNSINT

SEQ ID NO: 107 - DNA, 1653 bp, Synechococcus sp. PCC7336
  CDS (1)..(1653)
atgaatactgctgtcagaccttcattgccacaaaaggatcctaactccaacaagcgcaatgattatttagagcgcaaccgagaggattatcaattcgatcgcagcctattaccccctctccccttcatgcagaaggttccaaaacgggaatatttttcacccgaatataccgcgaaacggctcgccagtatggctaacctgcctgctaatatgctagctgctaaagctaagcgctttctcgatcccctcgatagcctggaagaatacgaggagctgattcctctgctatctaaacccaatctgctgaagaactatcgcactgacgaattttttggggagcagcgactgtcgggagccaacgccatggcaacgcgccgactggcaaaacttcccagtgattttgctgtggataatgctctgtttcagcaggtgttggagaccgatggaactctcgacgcagccttagctgaaggtagactttattttctggaacatccctatctcaatcgcatcaaaggaggggaatcggagtacggtcgcaaatacatgcccaaaacgcgatcgctgttctattggaaaagtgacgactctccagtggggggtgctcttttgccagtggcgatcgaactcaaaagcgaagccacgaataccccgattgtctatactcccaaagatgcccccctcgattggctgtttgccaaactctgcgtccaagtcgccgacgccaaccatcaagaattaggctcccactttgccttcacccacaccgccatggggccgtttgccatggttactgctcggcaattggctgaaaaccatcccgtgtcgctgttattagaacctcacttccagttcatgctgtttgataacgatttggggcgggcacagtttctcaaccccggcggtccagtcgatcgctttttggctggaactctcgaagaaacccttacttttgtggtcgacaccctcgatcgttggagtattgatacctttgacttcccatcgattatcgagcgccaaaacatggatgacccagaggtgctgccccactatccctttagagatgacggcatgttgatttgggatgctgtgaaggaatttattaccaattacctcagcatctattacaaaacccctgaggatattagggaggactacgaactacaaaattgggcgaaagaattagcagcatttgatagcggtcgagtcaagggaatgcccgaaactattgagtcattgcagcagctgatcgatatcctgtctgtcgtgattttcacctgtgctcccctgcattctaacttgaacttcactcaatacgaatacatgatcttcgttcccaatatgccttacgccgcatatcatccggtaccagagcagaaggggatcgatatggaaaccattctgaagtttctacccccctacaaacaagcggccgatcaagtgtattggacgatggtcttgacctcttaccatcacgacaagctaggcttttacgaagatgattttgccgatcctctagcccaagatgccctcgttcaattccagcaaaacctagcggatatcgaacgcaagatcgagattgaaaatcaacatcgtccggtcccctatcagtatttcttgccatctgaaattattaacagcattaatacttga

SEQ ID NO: 108 - protein, 550 aa, Synechococcus sp. PCC7336
MNTAVRPSLPQKDPNSNKRNDYLERNREDYQFDRSLLPPLPFMQKVPKREYFSPEYTAKRLASMANLPANMLAAKAKRFLDPLDSLEEYEELIPLLSKPNLLKNYRTDEFFGEQRLSGANAMATRRLAKLPSDFAVDNALFQQVLETDGTLDAALAEGRLYFLEHPYLNRIKGGESEYGRKYMPKTRSLFYWKSDDSPVGGALLPVAIELKSEATNTPIVYTPKDAPLDWLFAKLCVQVADANHQELGSHFAFTHTAMGPFAMVTARQLAENHPVSLLLEPHFQFMLFDNDLGRAQFLNPGGPVDRFLAGTLEETLTFVVDTLDRWSIDTFDFPSIIERQNMDDPEVLPHYPFRDDGMLIWDAVKEFITNYLSIYYKTPEDIREDYELQNWAKELAAFDSGRVKGMPETIESLQQLIDILSVVIFTCAPLHSNLNFTQYEYMIFVPNMPYAAYHPVPEQKGIDMETILKFLPPYKQAADQVYWTMVLTSYHHDKLGFYEDDFADPLAQDALVQFQQNLADIERKIEIENQHRPVPYQYFLPSEIINSINT

SEQ ID NO: 109 - DNA, 1638 bp, Nostoc flagelliforme
  CDS (1)..(1638)
atgaaaccttacttaccgcagaacgatccaaatggtaattatcgagcaagttggctggataaaaatagagaagagtacaattttaattatgattatctggctcctttaccagtaattgataaagtgcctcacaaggaaatattctcagcagaatatactgctaaacgcttggcaagtatggcaactcttgcaccaaatatgttggctgctaaagccagaaatttcttagacccgctagatgagttggaagaatatgaagaacttttggcactactaccaaaacccgatgtcataaaaaattataaaacagactcgtgttttgctgaacaacgactttcgggggcaaacccattagctatccgaagaattaatgtattacctgataattttgctgtaactgattaccattttcagaagattgcaggtgcagaatttactttggaaaaggcactcaaggaaggcaagctgtatttcttagattaccctttgctatctgatattcaaggtggtgtctataataatgttaaaaagtaccttcccaagccgcaagctctattttactggcaaagtaatgatagttttaatggtggttctctagtgcctgttgctatccagattaatcatgactctggcgcaaatagcctgtatacaccagatgacccccatttagattggtttttggcaaaaacctgcgtccaaattgctgatggcaaccaccaagaattgggtagtcatttttcctatacccatgcagttatggctccgtttgcaattgtaactgcgcggcaattagcagaaaatcatcccatcgccttactgttaaaacctcacttccgtttcatgctatttgataacgatttgggacgcactcagtttttacagcctggtggaccggttgatgagtttatggcaggttcattagcagaatctgttggatttgtggcgaaaacttatgaagaatggagtgtagaaaagtttaccttccctcggttaataaaaagccgtcaaacagatgacccagaaattttgccgcactttcctttccgggacgatggaatattaatctggaatgccatcgaaaagtttgtggctgaatacttgcaactctattataagacttcacaggatctcagcgatgactatgaattgcaaaattgggctagggaattagtcgcccaagatggtggtagagtcaagggaatgccagccaagattgagactttagaacaactgattgaaatcattagtgtagtagtcttcacttgcgctcctctccactctgctttgaatttttctcagtacgaatatatggcttttgtgcccaatatgccttatgcagcctaccacccaattccagaaactaagggtgtggatttggaaactattatgaaaatacttcctccctttaaacaagctgccgatcaggtaatgtggactgagattttgacatcgttccattatgacaaattaggtttttatgatgaggagtttgctgatccattggcgcaggaaattgtggtgcaattccaacataatctccatcaaatagaacggcaaatagacatcagaaatcaaactcgtcccataccttacaattaccttaaaccttcgcaaattattaatagcatcaatacttaa

SEQ ID NO: 110 - protein, 545 aa, Nostoc flagelliforme
MKPYLPQNDPNGNYRASWLDKNREEYNFNYDYLAPLPVIDKVPHKEIFSAEYTAKRLASMATLAPNMLAAKARNFLDPLDELEEYEELLALLPKPDVIKNYKTDSCFAEQRLSGANPLAIRRINVLPDNFAVTDYHFQKIAGAEFTLEKALKEGKLYFLDYPLLSDIQGGVYNNVKKYLPKPQALFYWQSNDSFNGGSLVPVAIQINHDSGANSLYTPDDPHLDWFLAKTCVQIADGNHQELGSHFSYTHAVMAPFAIVTARQLAENHPIALLLKPHFRFMLFDNDLGRTQFLQPGGPVDEFMAGSLAESVGFVAKTYEEWSVEKFTFPRLIKSRQTDDPEILPHFPFRDDGILIWNAIEKFVAEYLQLYYKTSQDLSDDYELQNWARELVAQDGGRVKGMPAKIETLEQLIEIISVVVFTCAPLHSALNFSQYEYMAFVPNMPYAAYHPIPETKGVDLETIMKILPPFKQAADQVMWTEILTSFHYDKLGFYDEEFADPLAQEIVVQFQHNLHQIERQIDIRNQTRPIPYNYLKPSQIINSINT

SEQ ID NO: 111 - DNA, 1644 bp, Nostoc punctiforme
  CDS (1)..(1644)
atggtgaaaccatatttaccacaaaaagatcctgatgttaatgtccgaatcaattggctagataaaaatcgagaagagtacaaatttaattacgattatctagctcctctaccagtaattgataaagttcctcataaggaaatattctcggcggaatatactgctaaacgtttggcaagtatggcaactcttgcaccaaatatgctagctgccaaagccagaaatttcttagacccattgaatgaattggaagaatatgaagaacttttgtcactcctaccaaaacctgatgttataaaaaattacaaaacagactcttgttttgcagaacaacgcctctctggagcaaacccattagctatccaaaaaattgatgtattacctgataattttgctgtcacagatgcacattttcagaaagtagcaggtacagaatttactttagaaaaggcacttaaggaaggcaagctgtatttcttagattatcctttgttatctgatattcaaggtggtatctacgagaatgttaaaaagtaccttcccaagccacaagctctattttattggcaaagtaatgatagttctaatggtggttctctagtacctgttgccattcagattaatcatgactctggtgcaaaaagcgtgatttatacaccagatgatccccatttagattggtttttggcaaaaacctgcgttcaaattgctgatggcaaccatcaagagttgggtagtcatttcgcctatacccatgcagttatggctccgtttgcaattgtaactgcgcggcaactagcagaaaatcatcccatcgctttactgttaaaaccccatttccgtttcatgctatttgataacgatttggggcgcactcagtttttacaacctggaggcccggttgatgagtttatggcaggttcattggcggagtctcttggatttgtggcgaaagtttatgaagaatggagtgttgaaaaatttacctttcctcggttaataaaaagtcgtcgaacggatgacccagaaattttaccgcactttccttttcgggatgatggcatattaatctggaatgccgtcgaaaagtttgtgtatgaatatttgcaactctattacaaaacctcacaggatctaattgatgactatgagttgcaaaattgggctagagaattagttgcccaagatggtggtaaagtcaagggaatgccagcgaagattgagactctagaacaactaatcgaaatcatcagtgtggtagtattcacttgcgctcctctacactctgctttgaatttttctcagtacgaatatatggcttttgtacccaatatgccctatgcagcctaccacccaattccagaaactaaaggtgtggacttggaaactatcatgaagatacttcctccctttaaacaagctgccgatcaggtgatgtggactgagattttaacatcgtaccactatgataaattgggtttttatgatgaggagtttgctgatccgttggcgcaggaaattgtggtgcaattccaacagaatttgcatgaaatagaacggcaaatagatattaaaaatcaaactcgtcccataccttacaactacttcaagccttcgcaaattattaacagcattaatacttga

SEQ ID NO: 112 - protein, 547 aa, Nostoc punctiforme
MVKPYLPQKDPDVNVRINWLDKNREEYKFNYDYLAPLPVIDKVPHKEIFSAEYTAKRLASMATLAPNMLAAKARNFLDPLNELEEYEELLSLLPKPDVIKNYKTDSCFAEQRLSGANPLAIQKIDVLPDNFAVTDAHFQKVAGTEFTLEKALKEGKLYFLDYPLLSDIQGGIYENVKKYLPKPQALFYWQSNDSSNGGSLVPVAIQINHDSGAKSVIYTPDDPHLDWFLAKTCVQIADGNHQELGSHFAYTHAVMAPFAIVTARQLAENHPIALLLKPHFRFMLFDNDLGRTQFLQPGGPVDEFMAGSLAESLGFVAKVYEEWSVEKFTFPRLIKSRRTDDPEILPHFPFRDDGILIWNAVEKFVYEYLQLYYKTSQDLIDDYELQNWARELVAQDGGKVKGMPAKIETLEQLIEIISVVVFTCAPLHSALNFSQYEYMAFVPNMPYAAYHPIPETKGVDLETIMKILPPFKQAADQVMWTEILTSYHYDKLGFYDEEFADPLAQEIVVQFQQNLHEIERQIDIKNQTRPIPYNYFKPSQIINSINT

SEQ ID NO: 113 - DNA, 1641 bp, Nostoc sp. 210A
  CDS (1)..(1641)
atgaaaccatatttaccacaaaaagatcctgatgttaatgtccgaatcaattggctagatagaaatcgagaagagtacaaatttaattacgattatctagctcctctaccagtcattgataaagttcctcataaggaaatcttctcggcagaatatactgctaaacgtttggcaagtatggcaagtcttgcaccaaatatgctagctgctaaagccagaaacttcttagacccattagatgaattggaagaatacgaagaacttttgtcactcctaccaaaacccgatgtcataaaaaattacaaaacagactcttgttttgcggaacaacgactctctggagcgaacccattagctatccaaaaaattgatgtattacctgataattttgctgtcacagatgcacattttcagaaggttgcaggtacagaatttactttgcaaaaagcactcaaggaaggcaagctgtatttcttagattatcctttattatctgatattaaaggtggtgtctacgataatgttaaaaagtaccttcccaagccacaagctctattttactggcaaagtaatgatagttctaatggtggttctctagtgcctgttgccatccagattaatcatgactctggtggaaaaagcgtgatttatacaccagatgacccccatttagattggtttttggcaaaaacctgcgttcaaattgctgatggcaaccatcaagaattgggtagtcatttcgcctatacccatgcagttatggctccgttcgcgattgtaactgcgcggcaactagcagaaaatcatcccatcgctttactgttaaaaccccacttccgttttatgctatttgataacgatttggggcgcactcagtttttacaacctggaggcccggttgatcagtttatggcaggttcattggcggagtctcttggatttgtagcgaaggtttatgaagaatggagtgttgaaaaatttaccttccctcggttaataaaaagtcgccgaaccgataacccagaaattttaccgcactttcctttccgggacgatggcatattaatttggaatgccgtcgaaaagtttgtggctgaatacttgcaactctattacaaaacctcacaagatatcagtgacgactatgagttgcaaaattgggctagagaattagtagctcaagatggtggtaaagtcaagggaatgccagccaagattgagactctagaacaactgattgaaatcatcagtgtggtagtattcacttgcgctcctctacattctgctttgaatttttctcagtacgaatatatggcttttgtacccaatatgccctatgcagcctaccacccaattccagaaactaaaggtgtggacttggaaactatcatgaagatacttcctccttttaaacaagctgccgatcaggtgatgtggactgagattttaacatcgtaccactatgacaaattgggtttttatgatgaggagtttgccgattcattggcgcaggaaattgtggtgcaattccaacaaaatttgcatgaaatagaacggcaaatagacattagaaatcaaactcgtcccataccttacaactacttcaagccttcggaaattattaacagcattaatacttga

SEQ ID NO: 114 - protein, 546 aa, Nostoc sp. 210A
MKPYLPQKDPDVNVRINWLDRNREEYKFNYDYLAPLPVIDKVPHKEIFSAEYTAKRLASMASLAPNMLAAKARNFLDPLDELEEYEELLSLLPKPDVIKNYKTDSCFAEQRLSGANPLAIQKIDVLPDNFAVTDAHFQKVAGTEFTLQKALKEGKLYFLDYPLLSDIKGGVYDNVKKYLPKPQALFYWQSNDSSNGGSLVPVAIQINHDSGGKSVIYTPDDPHLDWFLAKTCVQIADGNHQELGSHFAYTHAVMAPFAIVTARQLAENHPIALLLKPHFRFMLFDNDLGRTQFLQPGGPVDQFMAGSLAESLGFVAKVYEEWSVEKFTFPRLIKSRRTDNPEILPHFPFRDDGILIWNAVEKFVAEYLQLYYKTSQDISDDYELQNWARELVAQDGGKVKGMPAKIETLEQLIEIISVVVFTCAPLHSALNFSQYEYMAFVPNMPYAAYHPIPETKGVDLETIMKILPPFKQAADQVMWTEILTSYHYDKLGFYDEEFADSLAQEIVVQFQQNLHEIERQIDIRNQTRPIPYNYFKPSEIINSINT

SEQ ID NO: 115 - DNA, 1641 bp, Nostoc sp. Lobaria pulmonaria cyanobiont
  CDS (1)..(1641)
atgaaaccatacttaccacaaaaagatcctgatgttaatgtccgaatcaattggctagataaaaatcgagaagagtacaaatttaattacaattatctagctcctctaccaattattgataaagttcctcataaggaaatattctcggcggaatatactgctaaacgtttggcaagtatggcaactcttgcaccaaatatgctagctgctaaagccagaaacttcttagacccattagatgaattggaagaatatgaagaacttttatcactactaccaaaacccgatgttataaagaattacaaaacagactcttgttttgcggaacaaagactctctggagcgaacccactagctatccaaagaattgatgtattacctgataattttgctgtcacagattcccattttcagaaggttgcaggtacaaaattgacgttggaaaaggcactcaaggaaggcaagctgtatttcttagattaccctctgttatctgatattcaaggtggtgtctacgataatattcaaaagtaccttcccaagccacaagctctattttattggcaaagtaatgatagttctaatggtggttctctagtgcctgttgccatccagattaatcatgactctggtgcaaaaagcgtgatttatacaccagatgacccccatttagattggtttttggcaaaaacctgcgttcaaattgctgatggcaaccatcaagaattgggtagtcattttgcctatacccatgcagttatggctccgtttgcaattgtaactgcgcggcaactagcagaaaatcatcccatcgccttactgttaaaacctcacttccgttttatgctatttgataacgatttgggacgcactcagtttttacagccgggaggcccggttgatgagtttatggcaggctcattggcagagtctcttggctttgtggcgaaggtttatgaagaatggagtgttgaaaagtttaccttccctcggttaataaaaagtcgccgaacggatgacccagaaattttaccgcactttcctttccgggacgatggcatattaatttggaatgctgtcgaaaagtttgtggctgaatacttgcaactctattacaaaacctcacaagagttaattgatgactatgagttgcaaaattgggctagagaattagtggcccaagatggtggtaaagtcaagggaatgccagacaagattgagaccttagaacaactgattgaaatcatcagtgtggtagtattcacttgcgctcctctacactctgctttgaatttttctcagtacgaatatatggcttttgtacccaatatgccctatgcagcctaccacccaattccagaaattaaaggtgtggacttggaaactattatgaagatacttcctccctttaaacaagctgctgaccaagtaatgtggactgagattttaacatcgtaccactatgacaaattgggtttttatgatgaggagtttgccgatccattggcgcaggaaattgtggtgcaattccaacagaatttacatgaaatagaacggcaaatagacattagaaatcaaactcgtcccataccttacaactacttcaagccttcgcaaattattaacagtatcaatacttga

SEQ ID NO: 116 - protein, 546 aa, Nostoc sp. Lobaria pulmonaria cyanobiont
MKPYLPQKDPDVNVRINWLDKNREEYKFNYNYLAPLPIIDKVPHKEIFSAEYTAKRLASMATLAPNMLAAKARNFLDPLDELEEYEELLSLLPKPDVIKNYKTDSCFAEQRLSGANPLAIQRIDVLPDNFAVTDSHFQKVAGTKLTLEKALKEGKLYFLDYPLLSDIQGGVYDNIQKYLPKPQALFYWQSNDSSNGGSLVPVAIQINHDSGAKSVIYTPDDPHLDWFLAKTCVQIADGNHQELGSHFAYTHAVMAPFAIVTARQLAENHPIALLLKPHFRFMLFDNDLGRTQFLQPGGPVDEFMAGSLAESLGFVAKVYEEWSVEKFTFPRLIKSRRTDDPEILPHFPFRDDGILIWNAVEKFVAEYLQLYYKTSQELIDDYELQNWARELVAQDGGKVKGMPDKIETLEQLIEIISVVVFTCAPLHSALNFSQYEYMAFVPNMPYAAYHPIPEIKGVDLETIMKILPPFKQAADQVMWTEILTSYHYDKLGFYDEEFADPLAQEIVVQFQQNLHEIERQIDIRNQTRPIPYNYFKPSQIINSINT

SEQ ID NO: 117 - DNA, 1650 bp, Cyanosarcina burmensis
  CDS (1)..(1650)
atgaacgtaattcagccgtcatcagcgcaaatagagcgagaaacgcgccagtttttaccagatcgcgaccagtataagtttgactacgattttctcaaaccgctagctctgcttcaacccgttgttccagccttgccgactccaccaggctaccctcgcgtgcctgggtcttctaccttttcaccttactatgtattcacgcggtcgtcactgcctaacaccctcgacccctttgatggactgcaagcctttgatgattttttccccgcgcaggggaagccagaagtcagtaagatttatcaaagcgatcgctcttttgccgagcagagattatctggtgtgaatccgatggtacttcatcggattgtgcagattccgcctcaatcttctgtgacttatgaagaactccagctcgcttgcccccatctgcggctagatatggcattagccaatggcaatatttatgttgccgattacagtggactcggctttgtacaaggtggaacttttaaagacctgaaaaagtatttacccaccccagttgcatttttctactttgatgaaactcaacaagaattaatcccgattgcaattcaagtacagcccaaaccaggtggagcgattttcactccgcaagatacaccgctagattggctggtagccaagatgtgcgttcaaatagcagatgctaaccaccacgagatgggtgctcatttgtgctggacgcattttgtgatggaaccttttgccatttctacacctcggcaactagccatcaatcatccagtgcatttactgctagcgcctcatctgcgcttcctgttggcaattaacgatcaaggcagacaactgctagtcaatccctacgtcgatggtcaagtgggtggtcacgtcgatcgaattatggcaggcacgttagaggaatccttggaaattgtgaagcacacctattctgaatggagtttagacaagtttgctttcccgcaagaaatacagaatcgcggattggaggatgcgaacaaactgccgcacttcccttatcgagatgatggtctgttgctctggaatgccattcataagtttgtttccggttatctcaaatattgctatcccacacccgctgatattcaagcagatcgtgaattacaagcttgggcgcaggaactagcctcgccagatggtggacgggtcaaaggaatgccttgttcgttctcgacggtagagcaactgattgaggtgattgccaacgtgatttttacctgtggaccgcagcacgcagccgtgaactattcacaattcgactacatggcatacattccgaatatgccccatgctgcctatgtcaatatcactggtaaaggcatgattccagatgagaaagccctgatgaagttcttaccaccaagggatcaggcagaagctcaaatcaaaattgtcacttacctgtctttctatcggcacgatcgcctcggctattacgatcgagcgtttaaccttaccttccgcgaaactccagtcaagatgatggttcagcagttccaacaggagttgaatgagatcgagcagcggattgataccaggaatcggcaaaggtttgtaccttatccttatctcaagccttccttagttccaaatagctttagtgcttga

SEQ ID NO: 118 - protein, 549 aa, Cyanosarcina burmensis
MNVIQPSSAQIERETRQFLPDRDQYKFDYDFLKPLALLQPVVPALPTPPGYPRVPGSSTFSPYYVFTRSSLPNTLDPFDGLQAFDDFFPAQGKPEVSKIYQSDRSFAEQRLSGVNPMVLHRIVQIPPQSSVTYEELQLACPHLRLDMALANGNIYVADYSGLGFVQGGTFKDLKKYLPTPVAFFYFDETQQELIPIAIQVQPKPGGAIFTPQDTPLDWLVAKMCVQIADANHHEMGAHLCWTHFVMEPFAISTPRQLAINHPVHLLLAPHLRFLLAINDQGRQLLVNPYVDGQVGGHVDRIMAGTLEESLEIVKHTYSEWSLDKFAFPQEIQNRGLEDANKLPHFPYRDDGLLLWNAIHKFVSGYLKYCYPTPADIQADRELQAWAQELASPDGGRVKGMPCSFSTVEQLIEVIANVIFTCGPQHAAVNYSQFDYMAYIPNMPHAAYVNITGKGMIPDEKALMKFLPPRDQAEAQIKIVTYLSFYRHDRLGYYDRAFNLTFRETPVKMMVQQFQQELNEIEQRIDTRNRQRFVPYPYLKPSLVPNSFSA

SEQ ID NO: 119 - DNA, 1665 bp, Pseudanabaena sp. PCC6802
  CDS (1)..(1665)
atgaacgcgtataacttagatctggatccgacctatatcaaatacaaaactattctcactgaaaaccgcaacgaatatgaattcgatcttagcgatcgcgacctcgcacccataccgatgctgaagggaaacctgccgcgctcggaaaacttttccatcgattacctgggtagggtagcggctccaatggctaagctggcagcaaataccctggcggtcaaactaaaatctgcttgggatccgcttgacgaactgcaagactatgaagatttctttcaggttctggagaaacccaaagtcatctctacctaccaaagcgataaagcctttgccgaacaaagactgtccggccctaatcccctggtactcaagcgagttgatgacttagctcaatattttcagagcagcgatattgccgaaatagaaaccaaactaggcgactccatagatttgacagataacctgtacgttgccgactacaccgaactgctgcccattcccagcggcaccttcgatcgcgggcgtacctatttacccagaccgatcgctttgtttagctggcgcagtgaggcatctagcgatcgcggtcagctcgtgcccgtagcaattaaactcgacgtgccgctcaaagataaaaccatccttacgcccgaggatgaatcgctggactggctctatgccaaaacctgcgtgcagattgccgatggcaactatcacgaactaatgagccacctctgccgcacgcattttgtgatggaaccctttgcgatcgccaccggacagcatttgcccgaaacccatcatctcggagcgctcttgaggcagcattttaaatttatgctggcgttaagtaagtttgcccgcaaaaccctgattgccagcggtggttcgatcgatcgcatcttggcaggagaactatccggttccctagagatcatcaggcaagcctttagaacctggcggttcgatagtttttctttcccgcaagcgatcgcggcacgcggtatggacgatgcccaaaagctgcctcactacccctatcgcgatgatggcaagctggtttgggatgcaatttggcaatttgtttcagcttatttggggcttcactaccacactgccgatagtattagcagcgatcgggcgttgcaagactgggcgcaaaaactccatctcgtgtttagcatagctggcggtgatggcaaagggatgcctgcacaaatagatacgctggagcaattagtggaagttgtgactacgattgtcttcacctgcgggccgcaacacgcggcggtcaatttccctcaatacgagtacatgacctttgcacctaatatgccgctatcctcttatcgcgagtttgccggagcagcggagtttactcaaaaggatttcatgcgattcctaccgccatcccaacaagccgccggacagctctcgactacttttctactgtcttcattccgctacgatcggttggggcattacgatccatctttcttcgaggcctttgccgatggtatgcaggacaaagtcaaaactgtagtaacggcttttcagcagcaattggatgtggtagaggctgaaatcgatcgccgcaaccaaaaccggacagttccctatccctatctcaaaccatcgcttattcctaacagcattagcatctaa

SEQ ID NO: 120 - protein, 554 aa, Pseudanabaena sp. PCC6802
MNAYNLDLDPTYIKYKTILTENRNEYEFDLSDRDLAPIPMLKGNLPRSENFSIDYLGRVAAPMAKLAANTLAVKLKSAWDPLDELQDYEDFFQVLEKPKVISTYQSDKAFAEQRLSGPNPLVLKRVDDLAQYFQSSDIAEIETKLGDSIDLTDNLYVADYTELLPIPSGTFDRGRTYLPRPIALFSWRSEASSDRGQLVPVAIKLDVPLKDKTILTPEDESLDWLYAKTCVQIADGNYHELMSHLCRTHFVMEPFAIATGQHLPETHHLGALLRQHFKFMLALSKFARKTLIASGGSIDRILAGELSGSLEIIRQAFRTWRFDSFSFPQAIAARGMDDAQKLPHYPYRDDGKLVWDAIWQFVSAYLGLHYHTADSISSDRALQDWAQKLHLVFSIAGGDGKGMPAQIDTLEQLVEVVTTIVFTCGPQHAAVNFPQYEYMTFAPNMPLSSYREFAGAAEFTQKDFMRFLPPSQQAAGQLSTTFLLSSFRYDRLGHYDPSFFEAFADGMQDKVKTVVTAFQQQLDVVEAEIDRRNQNRTVPYPYLKPSLIPNSISI

SEQ ID NO: 121 - DNA, 1641 bp, Nostoc cycadae
  CDS (1)..(1641)
atgaaaccatatttaccccaggtagatcctaatcctaacatccgcaaagatgagctagtaaaaaatcaagcagattataaatttaatcacaattatctagctcctattcccgttatagataaagtccctcaccaagaattattctccgcagaatatacggctaaacgcctcgctagtatggcaaatttagcaccaaatatgctggctgccaaagcaagaaatttccttgaccctttagatgaattagaagaatacgaagaactattaacgctgctacctaaaccagcagtgatgaacaattataaaacagactcatgttttgccgagcaaagattatcaggtgcgaaccctttagctattcaaagaattgagaatttaccagaaaatattggagtaactaacgcacattttcaaaaagctgtcggcacagaaagtagtttagaagcggctctcaaagaaggtaaactttatctattagactatcccacactctttgatattaaaggtggtacctctcaaaacctgagaaagtatttacctaagccgcaagctttattttactggcagagcaacggtttaccaaatggtggttccttgcgtccagtagcaattaaattaaataatgatgctgggacagatggattgatttacactcctgatgacccttatctagattggtttttagcaaaaacctctgtgcagattgctgacggaaaccatcaagaattaggtagtcattttgcttatactcatgctgttatggctcctttttgtattgccacagcacgccaattagcagccaatcatcccattgctttactactaaaaccgcacttccggtttatgttatttgataacgatttaggacgcactcactttttacagccaggtgggccagtcgatgaatttatggctggttctttgcaagagtctttaacttttgtcgtgaaaacttatcaagagtggagtgtcgagaaatttgtcttcccgacattaatgagaaatcaaaatatggatgatccagaaatattaccgcattttccctttcgagatgatggaatattaatttgggatgccattcaaaaatttgttacagactatctgcaactttattaccaaacttcccaagatttgagcgaagattatgaattacaaaattgggcaagggaattagttgctcaagatggtggtcgcgttaaaggaatgccagaaaaaattgaaaccatagaccaattaattcaaattatcacggttgtaattttcacttgcgctcctttccactctgctttaaatttttctcagtacgagtatatggctttcgtaccgaatatgccctatgcagcttatcatccaacgccagaaaaaaagggcgtggatatgcaaactattatgaagatattaccacctttcaagcaagctgctgatcaagtaatgtggacacatattttaacatcgtaccaccacgacaaattggggtattacgatgaagaattttctgacccattggcacaggaattagtgatgcaattccaacagaatttgcatgatatagaacgaaaaattgatattagaaatcaaacccgtcctataccttataattacctcaaaccttcgcaaattattaacagtatcaatacttga

SEQ ID NO: 122 - protein, 546 aa, Nostoc cycadae
MKPYLPQVDPNPNIRKDELVKNQADYKFNHNYLAPIPVIDKVPHQELFSAEYTAKRLASMANLAPNMLAAKARNFLDPLDELEEYEELLTLLPKPAVMNNYKTDSCFAEQRLSGANPLAIQRIENLPENIGVTNAHFQKAVGTESSLEAALKEGKLYLLDYPTLFDIKGGTSQNLRKYLPKPQALFYWQSNGLPNGGSLRPVAIKLNNDAGTDGLIYTPDDPYLDWFLAKTSVQIADGNHQELGSHFAYTHAVMAPFCIATARQLAANHPIALLLKPHFRFMLFDNDLGRTHFLQPGGPVDEFMAGSLQESLTFVVKTYQEWSVEKFVFPTLMRNQNMDDPEILPHFPFRDDGILIWDAIQKFVTDYLQLYYQTSQDLSEDYELQNWARELVAQDGGRVKGMPEKIETIDQLIQIITVVIFTCAPFHSALNFSQYEYMAFVPNMPYAAYHPTPEKKGVDMQTIMKILPPFKQAADQVMWTHILTSYHHDKLGYYDEEFSDPLAQELVMQFQQNLHDIERKIDIRNQTRPIPYNYLKPSQIINSINT

SEQ ID NO: 123 - DNA, 1641 bp, Nostoc sp. HK-01
  CDS (1)..(1641)
atgaaaccatatttaccccaggtagatcctaatcctaacatccgcaaagatgagctagtcaaaaaccaaacagattataaatttaatcacaattatctagctcctattcccgttatagataaagtccctcaccaagaattattctccgcagaatatacggctaaacgcctcgctagtatggcaaatttagcaccaaatatgctggctgccaaagcaagaaatttccttgaccctttagatgaattagaagaatacgaagaactattaacgctgctacctaaaccagcagtgatgaacaattataaaacagactcatgttttgccgagcaaagattatcaggtgcgaaccctttagctattcaaagaattgatagtttaccagaaaagcttggaataacaaacgcccattttcaaaaatctgtcgggacagaaagtagtttagaagcggctctcaaagaaggtaaactttatttattagactatcccacactctttgatattaaaggtggtatttctcaaaacctgagaaagtatttacctaagccgcaagctttattttactggcagagcaacggtttaccaaatggtggttccttgcgtccagtagcaattaaattaaataatgatcctgggacagatggattgatttacactcctgatgatccttatctagattggtttttagcaaaaacctctgtgcagattgctgacggaaaccatcaagaattaggtagtcattttgcttatactcatgctgttatggctcctttttgtattgccacagcacgccaattagcagccaatcatcccattgctttactactaaaaccgcacttccggtttatgttatttgataacgatttaggacgcactcactttttacagccaggtgggccagtcgatgaatttatggctggttctttgcaagagtctttaacttttgtcgtgaaaacttatcaagagtggagtgtcgagaaatttgtcttcccgacattaatgagaaatcaaaatatggatgatccagaaatattaccgcattttccctttcgagatgatggaatattaatttgggatgccattcaaaaatttgttacagactatctgcaactttattaccaaacttcccaagatttgagcgaagattatgaattacaaaattgggcaagggaattagttgctcaagatggtggtcgcgttaaaggaatgccagaaaaaattgaaaccgtagaccaattaattcaaattatcacggttgtaattttcacctgcgctcctttccactctgctttaaatttttctcagtacgagtatatggctttcgtaccgaatatgccctatgcagcttatcatccaacgccagaaaaaaagggcgtggatatgcaaacgattatgaagatattaccacctttcaagcaagctgctgatcaagtaatgtggacacatattttaacatcgtaccaccacgacaaattggggtattacgatgaagaatttgctgacccattggcacaggaattagtggtgcaattccaacagaatttgcatgatatagaacgaaaaattgatattagaaatcaaactcgtcctataccttatgattacctcaaaccttcgcaaattattaacagtatcaatacttga

SEQ ID NO: 124 - protein, 546 aa, Nostoc sp. HK-01
MKPYLPQVDPNPNIRKDELVKNQTDYKFNHNYLAPIPVIDKVPHQELFSAEYTAKRLASMANLAPNMLAAKARNFLDPLDELEEYEELLTLLPKPAVMNNYKTDSCFAEQRLSGANPLAIQRIDSLPEKLGITNAHFQKSVGTESSLEAALKEGKLYLLDYPTLFDIKGGISQNLRKYLPKPQALFYWQSNGLPNGGSLRPVAIKLNNDPGTDGLIYTPDDPYLDWFLAKTSVQIADGNHQELGSHFAYTHAVMAPFCIATARQLAANHPIALLLKPHFRFMLFDNDLGRTHFLQPGGPVDEFMAGSLQESLTFVVKTYQEWSVEKFVFPTLMRNQNMDDPEILPHFPFRDDGILIWDAIQKFVTDYLQLYYQTSQDLSEDYELQNWARELVAQDGGRVKGMPEKIETVDQLIQIITVVIFTCAPFHSALNFSQYEYMAFVPNMPYAAYHPTPEKKGVDMQTIMKILPPFKQAADQVMWTHILTSYHHDKLGYYDEEFADPLAQELVVQFQQNLHDIERKIDIRNQTRPIPYDYLKPSQIINSINT

SEQ ID NO: 125 - DNA, 1641 bp, Anabaenopsis circularis
  CDS (1)..(1641)
atgaaaccatatttaccccaggtagatcctaatcctaacatccgcaaagatgagctattcaaaaaccaaacagattataaatttaatcacaattatctagctcctattcccgttatagataaagtccctcaccaagaattattctccgcagaatatacggctaaacgcctcgctagtatggcaaatttagcaccaaatatgctggctgccaaagcgagaaatttccttgaccctttagatgaattagaagaatacgaagaactattaacgctgctacctaaaccagcagtgatgaacaattataaaacagactcatgttttgccgagcaaagattatcaggtgcgaaccctttagctattcaaagaattgagaatttaccagaaaatattggagtaactaacgcacattttcaaaaagctgtcggcacagaaagtagtttagaagcggctctcaaagaaggtaaactttatttattagactatcccacactctttgatattaaaggtggtatttctcaaaacctgagaaagtatttacctaagccgcaagctttattttactggcagagcaacggtttaccaaatggtggttccttgcgtccagtagcaattaaattaaataatgatgctgggacagatggattgatttacactcctgatgacccttatctagattggtttttagcaaaaacctctgtgcagattgctgacggaaaccatcaagaattaggtagtcattttgcttatactcatgctgttatggctcctttttgtattgccacagcacgccaattagcagccaatcatcccattgctttactactaaaaccgcacttccggtttatgttatttgataacgatttaggacgcactcactttttacagccaggtgggccagtcgatgaatttatggctggttctttgcaagagtctttaacttttgtcgtgaaaacttatcaagagtggagtgtcgagaaatttgtcttcccgacattaatgaaaaatcaaaatatggatgatccagaaatattaccgcattttccctttcgagatgatggaatattaatttgggatgccattcaaaaatttgttacagaatatctgcaactttattaccaaacttcccaagatttgagcgaagattatgaattacaaaattgggcaagggaattagttgctcaagatggtggtcgcgttcaaggaatgccagaaaaaattgaagccgtagaccaattaattcaaattatcacggttgtaattttcacctgcgctcctttccactctgctttaaatttttctcagtacgagtatatggctttcgtaccgaatatgccctatgcagcttatcatccaacgccagaaaaaaagggcgtggatatgcaaactattatgaagatattaccacctttcaaacaagctgctgatcaagtaatgtggacacatattttaacatcgtaccaccacgacaaattggggtattacgatgaagaatttgctgacccattggcacaggaattagtggtgcaattccaacagaatttgcatgatatagaacgaaaaattgatattagaaatcaaactcgtcctataccttataattacctcaaaccttcgcaaattattaacagtatcaatacttga

SEQ ID NO: 126 - protein, 546 aa, Anabaenopsis circularis
MKPYLPQVDPNPNIRKDELFKNQTDYKFNHNYLAPIPVIDKVPHQELFSAEYTAKRLASMANLAPNMLAAKARNFLDPLDELEEYEELLTLLPKPAVMNNYKTDSCFAEQRLSGANPLAIQRIENLPENIGVTNAHFQKAVGTESSLEAALKEGKLYLLDYPTLFDIKGGISQNLRKYLPKPQALFYWQSNGLPNGGSLRPVAIKLNNDAGTDGLIYTPDDPYLDWFLAKTSVQIADGNHQELGSHFAYTHAVMAPFCIATARQLAANHPIALLLKPHFRFMLFDNDLGRTHFLQPGGPVDEFMAGSLQESLTFVVKTYQEWSVEKFVFPTLMKNQNMDDPEILPHFPFRDDGILIWDAIQKFVTEYLQLYYQTSQDLSEDYELQNWARELVAQDGGRVQGMPEKIEAVDQLIQIITVVIFTCAPFHSALNFSQYEYMAFVPNMPYAAYHPTPEKKGVDMQTIMKILPPFKQAADQVMWTHILTSYHHDKLGYYDEEFADPLAQELVVQFQQNLHDIERKIDIRNQTRPIPYNYLKPSQIINSINT

SEQ ID NO: 127 - DNA, 1734 bp, Pleurocapsa sp. PCC 7319
  CDS (1)..(1734)
atgaagaataagtcaaaaacaaatgtcggagaaaaaatggctattttttctcccgcattaagcgaagacgaattagcacaacgcactcaatacttaaaatttcaacaacaggaatatgagtttactcatgaatacgtagaaggtctaagtttatttaaagaagttcctgttcaagaaggcttttcaactgcttatcttgccgatagagaattccagctatcagcgatatcaatcaatatgttagcagtcgaaccacgtccttttcttgaccctttggaaacattaggagattacgaaaatttttataagattatccgaaaacctggtgttgccaacatttatcaaacagatcgtgcttttgccgaacaaagattgtctggggttaatcccttggtcattaaaaaatttaccgaaatgcctgctggtgttgatatttctttacaagatttaggtcaagaaactcaagttttattcagctccagcgcaactaatttgcaagcagaaattcaacgaggacatatcttcgttgccgactatacagaaagtttgtcttttgttgaaggtggaacttacgaaaaaggacgtaagtatttaccaaaaccaatcgcttttttctggtggcgtaaagatggcattaaagatcgcggtgaattagtccccattgctattgcgatcgagttaaatactgcggataaaaaatggaaaatcttgatacccagggacaaagatttgcactggacagctgccaaactttgcgtgcaaattgctgatgccaatcatcatgaaatgagtactcatttagggcgtacgcatcttgtaatggaaccttttgcggtcagtactgccagacaattagctaaaaatcatcctttaggattgcttttgcgccaacactttcgctttatgatagcgattaatgatatggctcgcagagagttgattaatccaggtggttttgtagaagcagcacttgcaggaacattgccagaatctctacgaattgttaaaaatgcttgtgttagttggaatattaaagattttgcctttcccacggagctcaaaaatcgtggtatggatgaaaaagacgatcgagataattacaaattaccccactatccctaccgcgatgatggtttaatgctttggaatgcgatcgaggattttgtaactggttatcttaagatcttttatcccaaacctgaggatattcaaagcgatcgagaattacaacaatgggcagcagaattagcatctgccgatggtggaaaagttgccaaaatgcccgaaaaaattagtgatattgaggaactaatcgaaattattaccactattatttttatttgtggtcctcaacattcggcggtgaattttccccaatatgaatatattggttttatacctaatatgcctctagctgcttatcaagaaattactggagcagaagatcaatttaaagaggaacgagatctgctacaacttttacctcctctaaaacaaacagcgactcaattactgacgatgtataacctttcaacttatcattacgatcgcctgggttattatgacgaagagtttgaaaatacggttaaaggtacagacattgaaccgatagttgccaaattcaaacaagatttgaatcaaatagaagtagagattgataataagaataaagatcgtactattccctatccgtttctaaagccttccttagttttaaacagtatttgtatctaa

SEQ ID NO: 128 - protein, 577 aa, Pleurocapsa sp. PCC 7319
MKNKSKTNVGEKMAIFSPALSEDELAQRTQYLKFQQQEYEFTHEYVEGLSLFKEVPVQEGFSTAYLADREFQLSAISINMLAVEPRPFLDPLETLGDYENFYKIIRKPGVANIYQTDRAFAEQRLSGVNPLVIKKFTEMPAGVDISLQDLGQETQVLFSSSATNLQAEIQRGHIFVADYTESLSFVEGGTYEKGRKYLPKPIAFFWWRKDGIKDRGELVPIAIAIELNTADKKWKILIPRDKDLHWTAAKLCVQIADANHHEMSTHLGRTHLVMEPFAVSTARQLAKNHPLGLLLRQHFRFMIAINDMARRELINPGGFVEAALAGTLPESLRIVKNACVSWNIKDFAFPTELKNRGMDEKDDRDNYKLPHYPYRDDGLMLWNAIEDFVTGYLKIFYPKPEDIQSDRELQQWAAELASADGGKVAKMPEKISDIEELIEIITTIIFICGPQHSAVNFPQYEYIGFIPNMPLAAYQEITGAEDQFKEERDLLQLLPPLKQTATQLLTMYNLSTYHYDRLGYYDEEFENTVKGTDIEPIVAKFKQDLNQIEVEIDNKNKDRTIPYPFLKPSLVLNSICI

SEQ ID NO: 129 - DNA, 1641 bp, Nostoc sp. MBR 210
  CDS (1)..(1641)
atgaaaccatacttaccccaggtagaccctaacccaaacattcgtaaagatgagctagtaaaaaatcgagaagattataaatttaatcatgattacctagctcctattcctgttattgataaagtcccccataaagaactcttctcggcagaatatacagctaaacgcctcgcaagtatggctaatttagcaccaaatatgttagccgccaaagccagaaattttcttgaccctttagatgaattagaagaatacgaagaactgttgacactgctacctaaaccagcagtaatgaataattataaaaccgattcatgttttgccgagcaaagattatcaggtgcgaaccctttagcaatacgcagaattgatagtttaccagcaaatctcggtatcaccaacgcccattttcaaaaatctgtcggcacagaaagtaacttagaagcggctctcaaagaaggtaaactttatctattagattatcctacactctttgatattaaaggtggaacttctcaaaatgtgagaaagtatttacctaagcctcaagctttattttactggcagagcaatggtgtagcaaatggtggttctctccgtccagtggcgattaaattaaataatgatgctggtacagatggattgatttacactcccgatgacccttatttagattggtttttagcaaaaacttctgtgcagatagctgacggaaatcatcaagaattaggtagtcattttgcatatactcatgctgttatggctccattttgtatcgccacagcacgccaattagcagcaaatcatcccatcgctttactactaagaccgcacttccggttcatgttatttgataacgatttaggacgcactcattttctacaaccaggtggcccagtcgatgaatttatggctggttctttagaagaatcattaacttttgtcgtcaaaacttaccaagaatggagtgttgataaatttgtcttcccgacattaatgaaaagtcaaaacatggatgacccagatatattaccgcattttccgttccgggatgatggtatattgatttggaatgccattcataaatttgtcacagattatttgcaactttattacaaaacacctcaagacttaagcgaagattatgaattgcaaaattgggcaagagaattagttgctcaagatggtggacgggttaaaggaatgccagagaaaattgaaactatcgaccaattaattcaagttattacggttatagtttttacctgcgctcctttccattcggctttaaattttgcccagtacgaatacatggctttcgtgccgaatatgccttatgcagcttatcatccaactcccgaaagtaagggtgtggatatgcaaaccatcatgaaactattgccaccattcaagcaagctgctgaccaagtaatgtggacacatattttaacatcttaccattacgataaattgggttattacgatgaagaatttgccgacccattggcacaggaattagttgtacagttccaacagaatttacatgatatagaacgacaaattgatattagaaatcaaactcgtcctataccttataatttcctcaaaccttcccaaattattaacagtatcaatacttaa

SEQ ID NO: 130 - protein, 546 aa, Nostoc sp. MBR 210
MKPYLPQVDPNPNIRKDELVKNREDYKFNHDYLAPIPVIDKVPHKELFSAEYTAKRLASMANLAPNMLAAKARNFLDPLDELEEYEELLTLLPKPAVMNNYKTDSCFAEQRLSGANPLAIRRIDSLPANLGITNAHFQKSVGTESNLEAALKEGKLYLLDYPTLFDIKGGTSQNVRKYLPKPQALFYWQSNGVANGGSLRPVAIKLNNDAGTDGLIYTPDDPYLDWFLAKTSVQIADGNHQELGSHFAYTHAVMAPFCIATARQLAANHPIALLLRPHFRFMLFDNDLGRTHFLQPGGPVDEFMAGSLEESLTFVVKTYQEWSVDKFVFPTLMKSQNMDDPDILPHFPFRDDGILIWNAIHKFVTDYLQLYYKTPQDLSEDYELQNWARELVAQDGGRVKGMPEKIETIDQLIQVITVIVFTCAPFHSALNFAQYEYMAFVPNMPYAAYHPTPESKGVDMQTIMKLLPPFKQAADQVMWTHILTSYHYDKLGYYDEEFADPLAQELVVQFQQNLHDIERQIDIRNQTRPIPYNFLKPSQIINSINT

SEQ ID NO: 131 - DNA, 1641 bp, Nostoc piscinale
  CDS (1)..(1641)
atgaaaccatacttaccccaggtagaccctaacccaaacatccgtaaagatgagctagtaaaaaatcgagaagattataaatttaatcatgattatttagctcctattcctgttattgataaagtcccccatcaagaactattttcggcagaatatacagctaaacgcctcgccagcatggcaaatttagcaccaaatatgttagctgccaaagccagaaattttcttgatcctttagatgaattagaagaatacgaagaactgttgacactgctacctaaaccagcagtgatgaacaattataagaccgattcatgttttgccgagcaaagattatcaggtgctaaccctttagcaattcggagaattgatagtttaccagcaaatctaggcatcacaaatgcccattttcaaaaatctgtcgggacagaaagtaacttggaagcggctctcaaagaaggtaaactttatctattagattatcctgcactttttgatattaaaggtggaacttctcaaaatgtgagaaagtatttacctaagcctcaagctttattttactggcagagcaatggtgtagcaaatggtggttcgctccatccagtggcgattaaattaaataatgatgctgggacagatggattgatttacactcccgatgacccttatctagattggtttttagcaaaaacttctgtacagattgctgacggcaaccatcaagaattaggtagtcattttgcctatactcatgctgttatggctcctttttgtattgccacagcacgccaattagccgcaaatcatcccattgctttactactaaaaccacatttccggttcatgttatttgataacgatttgggacgcactcatttcttacagccaggtggcccagtcgatgaatttatggctggttctttagaagaatcattaacttttgtcgtcaaaacttaccaagaatggagtgttgataaatttgtcttcccgacattaatgaaaagtcaaaacatggatgacccagatgtattaccacattttccgttccgggatgatgggatgttgatttggaatgccattcataaatttgtcacagattatttgcaactttattacaaaacttcccaagacttaagcgaagattatgaattgcaaaattgggcaagagaattagttgctcaagatggtggacgggttaaaggaatgccggacaaaattgaaactatcgaccaattaattcaaattattacggttgtagtttttacctgcgctcctttccattctgctttaaatttttcccagtacgaatacatggctttcgtaccaaatatgccttatgcagcttatcatcccactcctgaaagtaaaggtgtggatatgcaaactatcatgaagatattgccaccatttaagcaagctgctgaccaagtaatgtggacgcatattttaacatcttaccattacgataaattaggttattatgatgaggaatttgccgacccattagcacaggaattagttgtgcagttccaacagaatttacatgatatagaacgaaaaattgatattagaaatcaaactcgtcctataccgtataatttcctcaaaccttcccaaattattaacagtatcaatacttaa

SEQ ID NO: 132 - protein, 546 aa, Nostoc piscinale
MKPYLPQVDPNPNIRKDELVKNREDYKFNHDYLAPIPVIDKVPHQELFSAEYTAKRLASMANLAPNMLAAKARNFLDPLDELEEYEELLTLLPKPAVMNNYKTDSCFAEQRLSGANPLAIRRIDSLPANLGITNAHFQKSVGTESNLEAALKEGKLYLLDYPALFDIKGGTSQNVRKYLPKPQALFYWQSNGVANGGSLHPVAIKLNNDAGTDGLIYTPDDPYLDWFLAKTSVQIADGNHQELGSHFAYTHAVMAPFCIATARQLAANHPIALLLKPHFRFMLFDNDLGRTHFLQPGGPVDEFMAGSLEESLTFVVKTYQEWSVDKFVFPTLMKSQNMDDPDVLPHFPFRDDGMLIWNAIHKFVTDYLQLYYKTSQDLSEDYELQNWARELVAQDGGRVKGMPDKIETIDQLIQIITVVVFTCAPFHSALNFSQYEYMAFVPNMPYAAYHPTPESKGVDMQTIMKILPPFKQAADQVMWTHILTSYHYDKLGYYDEEFADPLAQELVVQFQQNLHDIERKIDIRNQTRPIPYNFLKPSQIINSINT

SEQ ID NO: 133 - DNA, 1656 bp, Microcystis aeruginosa
  CDS (1)..(1656)
atgctgacaccatcgctcccaaaaaatgattctgatccagtcaaaagacaagatctattaagacgacaaaaacaagtgtacatttatgattccgttaatggtatcaccctcgtcaaagatttacctacccacgaaaacttttctatttcctatcaagtaatgcggggtaaaggtttcagtgctttaattgccaatggcgtagccacgagaatagaaaatgtctttgatcccttcgacaaattagaagattacgaagaactttttcctatccttcccaaacccacaagcattaaaacttggcaatctaacacaggttttgcctaccaaagattagcgggagcaaatcccatggtaattcgcgggattagcagcttaccaaataatttccccgtcagcgatactatcttccaaaaagccatgggaccggataaaaccattgcctcggaagccgctaagggtaacttatttctagcagattatgcacccctaaacaacctaactttaggcagttatcaacgggggatgaaagctgtgacagcacctcttgtccttttctgttggcgtgctagaggtttacgcggtcaagggggattagtaccagttgccattcaattgtatcaagatccgacccaacctaatcagcgcatctatacccccgatgacggacttaattggttaatggcgaagattttcgtgcaaattgccgacggaaaccaccatgaattagttagtcacctcagccatacccatttagtagcggaagcttttgttttagccacagctaccgagttagcactcaatcatcctctggcaattctattaagacctcattttcaatttaccctcgccattaatagtttagccgagagcgagttaattaaccccggcggatttgttgatcgtctattagcggggacgctagaagcatcgatcgagctaattaagagttcctatcgtcaaagattagataatttcgccgattatgccctaccaaaggaattagcattgcgccaagtccaggatacctcgctactaccagattacccctaccgagacgatgctctcttactttggcaagcaacggaaacctacgtcaaagattacctaagtctttactatacttccgacgcggatgtaaacggggatacagaattacaagcttgggcgcgaaaattgatgtcacctgaaggtggaggcatcaaaaaattagtttttgacggacaattagacactttagccaaattagtcgaagttgtcacccagataatttttgtggccggaccacaacacgcggcggttaattatcctcaatacgattatctcgccttttgcccgaatattcccctagcgggttatcaatcccctcccaaagcagctgaagaggtggatatagattatattctccgtcttttgccgccccaggcccaggccgcttatcaattggaaattatgcagactttaacagcttttcaatttaaccgttttggttatccatcccgaagtgctttcccagatcaacgcacttacccgattttggcggttttccaagctaaattaaaagcgatcgaaaatcagatcgatcggcgcaatttaacccgatttacgccttatattttcctgaaaccctctcgcatccccaatagtatcaatatttag

SEQ ID NO: 134 - protein, 551 aa, Microcystis aeruginosa
MLTPSLPKNDSDPVKRQDLLRRQKQVYIYDSVNGITLVKDLPTHENFSISYQVMRGKGFSALIANGVATRIENVFDPFDKLEDYEELFPILPKPTSIKTWQSNTGFAYQRLAGANPMVIRGISSLPNNFPVSDTIFQKAMGPDKTIASEAAKGNLFLADYAPLNNLTLGSYQRGMKAVTAPLVLFCWRARGLRGQGGLVPVAIQLYQDPTQPNQRIYTPDDGLNWLMAKIFVQIADGNHHELVSHLSHTHLVAEAFVLATATELALNHPLAILLRPHFQFTLAINSLAESELINPGGFVDRLLAGTLEASIELIKSSYRQRLDNFADYALPKELALRQVQDTSLLPDYPYRDDALLLWQATETYVKDYLSLYYTSDADVNGDTELQAWARKLMSPEGGGIKKLVFDGQLDTLAKLVEVVTQIIFVAGPQHAAVNYPQYDYLAFCPNIPLAGYQSPPKAAEEVDIDYILRLLPPQAQAAYQLEIMQTLTAFQFNRFGYPSRSAFPDQRTYPILAVFQAKLKAIENQIDRRNLTRFTPYIFLKPSRIPNSINI

SEQ ID NO: 135 - DNA, 1656 bp, Microcystis aeruginosa
  CDS (1)..(1656)
atgctgacaccatcgctacccaaaaatgatcctgatccagtcaaaagacaagatctattaagacgacaaaaacaagtgtacatttatgattccgttaatggtatcaccctcgtcaaagatttacctacccacgaaaacttttctatttcctatcaagtaatgcggggtaaaggtttcagtgctttaattgccaatggagtcgccacaagagtagaaaatatcttcgatcccttcgacacattagaagattacgaagaactttttcctatccttcccaaacccacaagcattaaaacttggcaatctaatacaggttttgcctaccaaagattagcgggagcaaatcccctggtaattcgcgggattagcagcttaccagataatttccccgtcagcgatgccatcttccaaaaagccatgggaccggataaaaccattgactcggaagccgctaagggtaacttatttctagcagattatgcccccctaaacaacctaactttaggcagttatcaaaagggcatgaaaactgtaacagcacctcttgtccttttctgttggcgtgctagaggtttacgcggtcaagggggattagtacctgttgccattcaattatatcaggatccgacccaacctaatcagcgcatctatacccccgatgacggacttaattggttaatggcgaagattttcgtgcaaattgccgacggaaatcaccatgaattagttagtcacctcagccatacccatttagtagcggaagcttttgttttagatacagctaccgagttagcaatcaatcatcctctggcaattctattaagacctcattttcaatttaccctcgctattaatagtttagccgagagcgagttaattaaccctggcggattcgttgatcgtctattagcggggacgctagaagcatctatcgagataattaagacttcctatcgtcaaagattggataatttcgccgattataccctacccaagcaattagccttccgccaagtcgatgatacctccctactaccagattacccctaccgagacgatgctctcttactttggcaagcaacggaaacctacgtcaaagattacctaagtctttactatacttccgacgcggatgtaaacggggatacagaattacaagcttgggtgcgaaaattgatgtcacctgaaggtggaggcatcaaaaaattagtttctgacggagaattagacactttagccaaattagtcgaagttgtcacccagataatttttgtggccggaccacaacacgcggcggttaattatcctcaatacgattatctcgccttttgcccgaatattcccctagcgggttatcaatctcctcccaaagcagctgaggaggtggatatagattatattctccgtcttttgccgccccagtcccaggccgcttatcaattggaaattatgcagactttaacagcttttcaatttaaccgttttggctatccatcccgaagtgctttcccagatcaacgcacttacccgattttggcggttttccaagctaaattaaaggcgatcgaaaatgagatcgatcggcgcaatttaacccgatttacgccttatattttcctgaaaccctctcgcatccccaatagtatcaatatttag

SEQ ID NO: 136 - protein, 551 aa, Microcystis aeruginosa
MLTPSLPKNDPDPVKRQDLLRRQKQVYIYDSVNGITLVKDLPTHENFSISYQVMRGKGFSALIANGVATRVENIFDPFDTLEDYEELFPILPKPTSIKTWQSNTGFAYQRLAGANPLVIRGISSLPDNFPVSDAIFQKAMGPDKTIDSEAAKGNLFLADYAPLNNLTLGSYQKGMKTVTAPLVLFCWRARGLRGQGGLVPVAIQLYQDPTQPNQRIYTPDDGLNWLMAKIFVQIADGNHHELVSHLSHTHLVAEAFVLDTATELAINHPLAILLRPHFQFTLAINSLAESELINPGGFVDRLLAGTLEASIEIIKTSYRQRLDNFADYTLPKQLAFRQVDDTSLLPDYPYRDDALLLWQATETYVKDYLSLYYTSDADVNGDTELQAWVRKLMSPEGGGIKKLVSDGELDTLAKLVEVVTQIIFVAGPQHAAVNYPQYDYLAFCPNIPLAGYQSPPKAAEEVDIDYILRLLPPQSQAAYQLEIMQTLTAFQFNRFGYPSRSAFPDQRTYPILAVFQAKLKAIENEIDRRNLTRFTPYIFLKPSRIPNSINI

SEQ ID NO: 137 - DNA, 1656 bp, Microcystis aeruginosa
  CDS (1)..(1656)
atgctgacaccatcgctaccccaaaatgatcctgatccagccaaaagacaagagctattaagacgacaaaaacaagtgtacatctatgattccgttaatggtatcaccctcgtcaaagatttacctacccacgaaaacttttctatttcctatcaagtaatgcggggtaaaggtttcagtgctttaattgccaatggcgtggccacgagaatagaaaacgtctttgatcccttcgacaaattagaagattacgaagaactttttcccatccttccccaacccacaagcattaaaacttggcaatctaacacaagttttgcctaccaaagattagcgggagcaaatcccatggtcatccgcgggattagcagcttaccggataattttcccgtcagcgatgctatcttccaaaaagccatgggacctgataaaaccattgcctcggaagccgctaagggtaacttatttctagcagattatgcccccctaaacaacctaactttaggcagttatcaaaagggtatgaaaactgtaacagcacctcttgtccttttctgttggcgtgctagaggtttacggggtcaagggggattagtaccagttgccattcaattatatcaagatccgactcaacctaatcagcgcatctatacccccgatgacggacttaattggttaatggcgaaaattttcgtccaaattgccgacggaaatcaccatgaattagttagtcacctcagccatacccatttagtagcggaagcttttgttttagccacagctaccgagttagcacttaatcatcctctggcaattctattaagacctcattttcaatttaccctcgctattaatagtttagccgagagcgagttaattaaccccggcggattcgttgatcgtctattagcggggacgctagaagcatcgatcgagctaattaagagttcctatcgtcaaagattagataatttcgccgattatgccctaccaaagcaattagaattgcgccaagtccaggatacctcgctactaccagattacccctaccgagacgatgctctcttactttggcaagcaacggaaacctacgtcaaagattacctaagtctttactatacttccgatgcggacgtaaatgaggatacagaattacaagcttgggtgcgaacattgatgtcacctgaaggtggaggcatcaaaaaattagtttctgaaggagaattagacactttggccaaattaatcgaagttgtcacccagataatttttgtggccggaccacaacacgcggcggttaattatcctcaatacgattatctcgccttttgcccgaatattcccctagcgggttatcaatctcctcccaaagcagctgagcaggtggatatagattatattctccgtcttttgcccccccaggcccaggccgcttatcaattggaaattatgcagactttaacagcttttcaatttaaccgttttggctatccatcccgaagtgctttcccagatcaacgcacttacccgattttggcggttttccaagctaaattaaaggcgatcgaaaatcagatcgatcggcgcaatttaacccgatttacgccttatattttcctgaaaccctctcgcatccccaatagtatcaatatttag

SEQ ID NO: 138 - protein, 551 aa, Microcystis aeruginosa
MLTPSLPQNDPDPAKRQELLRRQKQVYIYDSVNGITLVKDLPTHENFSISYQVMRGKGFSALIANGVATRIENVFDPFDKLEDYEELFPILPQPTSIKTWQSNTSFAYQRLAGANPMVIRGISSLPDNFPVSDAIFQKAMGPDKTIASEAAKGNLFLADYAPLNNLTLGSYQKGMKTVTAPLVLFCWRARGLRGQGGLVPVAIQLYQDPTQPNQRIYTPDDGLNWLMAKIFVQIADGNHHELVSHLSHTHLVAEAFVLATATELALNHPLAILLRPHFQFTLAINSLAESELINPGGFVDRLLAGTLEASIELIKSSYRQRLDNFADYALPKQLELRQVQDTSLLPDYPYRDDALLLWQATETYVKDYLSLYYTSDADVNEDTELQAWVRTLMSPEGGGIKKLVSEGELDTLAKLIEVVTQIIFVAGPQHAAVNYPQYDYLAFCPNIPLAGYQSPPKAAEQVDIDYILRLLPPQAQAAYQLEIMQTLTAFQFNRFGYPSRSAFPDQRTYPILAVFQAKLKAIENQIDRRNLTRFTPYIFLKPSRIPNSINI

SEQ ID NO: 139 - DNA, 1656 bp, Microcystis aeruginosa
  CDS (1)..(1656)
atgctgacaccatcgctacccaaaaatgatcctgatccagtcaaaagacaagatctattaagacgacaaaaacaagtgtacatctatgattccgttaatggtatcaccctcgtcaaagatttacctacccacgaaaacttttctatttcctatcaagtaatgcggggtaaaggtttcagtgctttaattgccaatggcgtagccacgagaatagaaaatgtctttgatccctttgataaattagaagattacgaagaactttttcctatccttcccaaacccacaagtattaaaacttggcaatctaacacaggttttgcctaccaaagattagcgggagcaaatcccatggtaattcgcggtattagcagcttaccggataattttcccgtcagcgatgccatcttccaaaaagccatgggaccggataaaaccattgcctcggaagctgctaggggtaacttatttctagcagattatgcccccctaaacaacctaactttaggcaattatcaaagggggatgaaagctgtgacagcacctcttgtccttttctgttggcgtgctagaggtttacgtggtcaagggggattagtaccggttgccattcaattatatcaggatcctacccaacctaatcagcgcatctatactcccgatgacggacttaattggttaatggcgaagattttcgtgcaaattgccgacggaaaccaccatgaattagttagtcacctcagccatacccatttagtagcggaagcttttgttttagccacagctaccgagttagcactcaatcatcctctggcgattctattaagacctcattttcaatttaccctcgccattaatagtttagccgagagcgagttaattaacccaggcggatttgttgatcgtctattagcggggacgctagaggcatcgatcgagctaattaagagttcctatcgtcaaagattagataatttcgccgattatgccctaccaaagcaattagaattgcgccaagtccaggatacctcgctactaccagattacccctaccgagacgatgctctcttactttggcaagcaacggaaacctacgtcaaagattacctaagtctttactatacttccgacgcggacgtaaacgaggatacagaattacaagcttgggtgcgaaaattgatgtcacctgaaggtggaggcatcaaaaaattagtttctgacggacaattagacactttagccaaattaatcgaagttgtcacccagataatttttgtggccggaccacaacacgcggcggttaattattctcaatacgattatctcgccttttgcccgaatattcccctagcgggttatcaatctcctcccaaagcagctgaggaggtggatatagattatattctccgtcttttgccgccccaggcccaggccgcttatcaattggaaattatgcagactttaacagcttttcaatttaaccgttttggttatccatcccgcagtgctttcccagatcaacgcacttacccgattttggcggttttccaagctaaattaaaagcgatcgaaaatgagatcgatcggcgcaatttaacccgatttacgccttatattttcctgaaaccctctcgcatccccaatagtatcaatatttag

SEQ ID NO: 140 - protein, 551 aa, Microcystis aeruginosa
MLTPSLPKNDPDPVKRQDLLRRQKQVYIYDSVNGITLVKDLPTHENFSISYQVMRGKGFSALIANGVATRIENVFDPFDKLEDYEELFPILPKPTSIKTWQSNTGFAYQRLAGANPMVIRGISSLPDNFPVSDAIFQKAMGPDKTIASEAARGNLFLADYAPLNNLTLGNYQRGMKAVTAPLVLFCWRARGLRGQGGLVPVAIQLYQDPTQPNQRIYTPDDGLNWLMAKIFVQIADGNHHELVSHLSHTHLVAEAFVLATATELALNHPLAILLRPHFQFTLAINSLAESELINPGGFVDRLLAGTLEASIELIKSSYRQRLDNFADYALPKQLELRQVQDTSLLPDYPYRDDALLLWQATETYVKDYLSLYYTSDADVNEDTELQAWVRKLMSPEGGGIKKLVSDGQLDTLAKLIEVVTQIIFVAGPQHAAVNYSQYDYLAFCPNIPLAGYQSPPKAAEEVDIDYILRLLPPQAQAAYQLEIMQTLTAFQFNRFGYPSRSAFPDQRTYPILAVFQAKLKAIENEIDRRNLTRFTPYIFLKPSRIPNSINI

SEQ ID NO: 141 - DNA, 1656 bp, Microcystis aeruginosa
  CDS (1)..(1656)
atgctgacaccatcgctaccccaaaatgatcctgatccagccaaaagacaagatctattaagacgacaaaaacaagtgtacatttatgattccgttaatggtatcaccctcgtcaaagatttacctacccacgaaaacttttctatttcctatcaagtaatgcggggtaaaggtttcagtgctttaattgccaatggagtcgccacaagggtagaaaatatcttcgatccctttgataaattagaagattacgaagaactttttcccctccttccccaacccacaagcattaaaaattggcaatctaacacaagttttgcctaccaaagattagcgggagcaaatcccatggtcatccgggggattagcagcttaccggataatttcccagtcaccgatgctatcttccaaaaagctatgggaccggataaaaccattgcctcggaagccgctaagggtaacttatttctagcagattatgccaccctacaccacctaactttaggcagttatcaaaggggtatgaaaactgtgacagcacctcttgtccttttctgttggcgtgctagaggtttacgcggtcaagggggattagtaccagttgccattcaattgtatcaggatccgaccctacctaatcagcgcatctatacccccgatgacggacttaattggttaatggcgaaaattttcgtgcaaattgccgacggaaatcaccatgaattagttagtcacctcacccatacccatttagtagcggaagcttttgttttagccacagctaccgagttagcacttaatcatcctctggcaattctattaagacctcattttcaatttaccctcgctattaatactctagccgagagcgagttaattagccctggcggattcgttgatcgtctattagcggggacgctagaagcatcgatcgagctaattaagagttcctatcgtcaaagattggataatttcgccgattatgccctaccaaagcaattagaattgcgccaagtccaggatacctcgctactaccagattacccctaccgagacgatgctctcttactttggcaagcaacggaaacctacgtcaaagattacctaagtctttactatacttccgatgcggatgtaaacggggatacagaattacaagcctgggtgcgaaaattgatgtcacctgaaggtggaggcatcaaaaaattagtttctgacggacaattagacactttagccaaattaatcgaagttgtcacccagataatttttgtggctggaccacaacacgcggcggttaattatcctcaatacgattatctcgccttttgcccgaatattcccctagcgggttatcaatcccctcccaaagcagctgaggaagtggatatagattatattctccgtcttttgccgccccaggcccaggccgcttatcaattggaaattatgcagactttaacagcttttcaatttaaccgttttggttatccatcccgaagtgctttcccagatcaacgcacttacccgattttggcggttttccaagctaaattaaaagcgatcgaaaatgagatcgatcggcgcaatttaacccgatttacgccttatattttcctgaaaccctctcgcatacccaatagtatcaatatttga

SEQ ID NO: 142 - protein, 551 aa, Microcystis aeruginosa
MLTPSLPQNDPDPAKRQDLLRRQKQVYIYDSVNGITLVKDLPTHENFSISYQVMRGKGFSALIANGVATRVENIFDPFDKLEDYEELFPLLPQPTSIKNWQSNTSFAYQRLAGANPMVIRGISSLPDNFPVTDAIFQKAMGPDKTIASEAAKGNLFLADYATLHHLTLGSYQRGMKTVTAPLVLFCWRARGLRGQGGLVPVAIQLYQDPTLPNQRIYTPDDGLNWLMAKIFVQIADGNHHELVSHLTHTHLVAEAFVLATATELALNHPLAILLRPHFQFTLAINTLAESELISPGGFVDRLLAGTLEASIELIKSSYRQRLDNFADYALPKQLELRQVQDTSLLPDYPYRDDALLLWQATETYVKDYLSLYYTSDADVNGDTELQAWVRKLMSPEGGGIKKLVSDGQLDTLAKLIEVVTQIIFVAGPQHAAVNYPQYDYLAFCPNIPLAGYQSPPKAAEEVDIDYILRLLPPQAQAAYQLEIMQTLTAFQFNRFGYPSRSAFPDQRTYPILAVFQAKLKAIENEIDRRNLTRFTPYIFLKPSRIPNSINI

SEQ ID NO: 143 - DNA, 1656 bp, Microcystis flos-aquae DF17
  CDS (1)..(1656)
atgctgacaccatcgctccccaaaaatgatcctgatccagtcaaaagacaagagctattaagacgacaaaaacaagtgtacatttatgattccgttaatggtatcaccctcgtcaaagatttacctacccacgaaaacttttctatttcctatcaagtaatgcggggtaaaggtttcagtgctttaattgccaatggagtcgccacaagggtagaaaatatcttcgatccctttgacaaattagaagattacgaagaactttttcccatccttccccaacccacaagcattaaaacttggcaatctaacacaagttttgcctaccaaagattagcgggagcaaatcccatggtaatccgcgggattagcagcttaccaaataattttcccgtcagcgatgctatcttccaaaaagctatgggacccgataaaaccattgcctcggaagccgctaagggtaacttatttctagcagattatgcccccctacaccacctaactttaggcagttatcaaaggggtatgaaaactgtgacagcacctcttgtccttttctgttggcgtgctagaggtttacggggtcaagggggattagtaccagttgccattcaattgtatcaggatccgaccctacctaatcagcgcatctatacccccgatgacggacttaattggttaatggcgaaaattttcgtgcaaattgccgacggaaatcaccatgaattagttagtcacctcagccatacccatttagtagcggaagcttttgttttagccacagctaccgagttagcacttaatcatcctctggcaattctattaagacctcattttcaatttaccctcgctattaatagtttagccgagagcgagttaattaaccccggcggattcgttgatcgtctattagcggggaccctagaagcatctatcgagctaattaagagttcctatcgtcaaagattggataatttcgccgattatgccctaccaaagcaattagaattgcgccaggtccaggatacctccctactaccagattacccctaccgagacgatgctctcttactttggcaagcaacggaaacctacgtcaaagattacctaagtctttactatacttccgacgcggacgtaaacgaggatacagaattacaagcttgggcgcgaaaattgatgtcatctgaaggtggaggcatcaaaaaattagtttctgacggagaattagacactttagccaaattagttgaagttgtcacccagataatttttgtggccggaccacaacacgcggcggttaattatcctcaatacgattatctcgcctttagccccaatattcccctagcgggttatcaatcccctcccaaagcagctgaggaagtggatatagattatattctccgtcttttgccgccccaggcccaggccgcttatcaattggaaattatgcagactttaacagcttttcaatttaaccgttttggttatccatcccgaagtgctttcccagatcaacgtgcttacccgattttggcggttttccaagctaaattaaaagcgatcgaaaatgagatcgatcggcgcaatttaacccgatttacgccttatattttcctgaaaccctctcgcatacccaatagtatcaatatttag

SEQ ID NO: 144 - protein, 551 aa, Microcystis flos-aquae DF17
MLTPSLPKNDPDPVKRQELLRRQKQVYIYDSVNGITLVKDLPTHENFSISYQVMRGKGFSALIANGVATRVENIFDPFDKLEDYEELFPILPQPTSIKTWQSNTSFAYQRLAGANPMVIRGISSLPNNFPVSDAIFQKAMGPDKTIASEAAKGNLFLADYAPLHHLTLGSYQRGMKTVTAPLVLFCWRARGLRGQGGLVPVAIQLYQDPTLPNQRIYTPDDGLNWLMAKIFVQIADGNHHELVSHLSHTHLVAEAFVLATATELALNHPLAILLRPHFQFTLAINSLAESELINPGGFVDRLLAGTLEASIELIKSSYRQRLDNFADYALPKQLELRQVQDTSLLPDYPYRDDALLLWQATETYVKDYLSLYYTSDADVNEDTELQAWARKLMSSEGGGIKKLVSDGELDTLAKLVEVVTQIIFVAGPQHAAVNYPQYDYLAFSPNIPLAGYQSPPKAAEEVDIDYILRLLPPQAQAAYQLEIMQTLTAFQFNRFGYPSRSAFPDQRAYPILAVFQAKLKAIENEIDRRNLTRFTPYIFLKPSRIPNSINI

SEQ ID NO: 145 - DNA, 1656 bp, Microcystis aeruginosa
  CDS (1)..(1656)
atgctgacaccatcgctaccccaaaatgatcctgatccagccaaaagacaagatctattaagacgacaaaaacaagtgtacgtctatgattccgttaatggtatcaccctcgtcaaagatttacccacccacgaaaacttttctatttcctatcaagtaatgcggggtaaaggtttcagtgctttaattgccaatggagtggccacaagagtagaaaatatcttcgatccctttgacaaattagaagattacgaagaactttttcccatccttcccaaacccacaagtattaaaacttggcaatctaacacaagttttgcctaccaaagattagcaggagcaaatcccatggtaattcgcgggattagcagcttaccagataatttcccagtcaccgatgctatcttccaaaaagccatgggaccggataaaaccattgcctcggaagccgctaagggtaacttatttctagcagattatgcccccctacaccacctaactttaggcagttatcaaaagggtatgaaaactgtaacagcacctcttgtccttttctgttggcgtgctagaggtttacgcggtcaagggggattagtacctgttgccattcaattatatcaggatcctacccaacctaatcagcgcatctatacccccgatgacggacttaattggttaatggcgaagattttcgtgcaaattgccgacggaaatcatcatgaattagttagtcacctcagccatacccatttagtagcggaagcttttgttttagccacagctaccgagttagcactcaatcatcctctggcaattctattaagacctcattttcaatttaccctcgccattaatagtttagccgagagcgagttaattaaccccggcggattcgttgatcgtctattagcggggacgctagaagcatctatcgagataattaagacttcctatcgtcaaagattggataatttcgccgattataccctacccaagcaattagccttccgccaagtcgatgatacctccctactaccagattacccctaccgagacgatgctctcttactttggcaagcaacggaaacctacgtcaaagattacctaagtctttactatacttccgacgcggatgtaaacaaggatacagaattacaagcttgggtgcgaaaattgatgtcacctgaaggtggaggcattaaaaaattagtttctgacggaaaattagacactttagccaaattaatcgaagttgtcacccagataatttttattgctggaccacaacacgcggcggttaattattctcaatacgattatctcgccttttgcgcgaatattcccctagccggttatcaatctcctcccaaagcatctgaggaggtggatatggattatattctccgtcttttgcccccccaggcccaggccacttatcaattggaaattatgcacactttaacagcttttcaattcaaccgttttggttatccatcccgaaatgatttcccagatcaacgcacttacccgattttggcggttttccaagctaaattaaaagcgatcgaaaatgagatcgatcggcgcaattcaacccgaattacgccttatattttcctgaaaccctctcgcatccccaatagtatcaatatttaa

SEQ ID NO: 146 - protein, 551 aa, Microcystis aeruginosa
MLTPSLPQNDPDPAKRQDLLRRQKQVYVYDSVNGITLVKDLPTHENFSISYQVMRGKGFSALIANGVATRVENIFDPFDKLEDYEELFPILPKPTSIKTWQSNTSFAYQRLAGANPMVIRGISSLPDNFPVTDAIFQKAMGPDKTIASEAAKGNLFLADYAPLHHLTLGSYQKGMKTVTAPLVLFCWRARGLRGQGGLVPVAIQLYQDPTQPNQRIYTPDDGLNWLMAKIFVQIADGNHHELVSHLSHTHLVAEAFVLATATELALNHPLAILLRPHFQFTLAINSLAESELINPGGFVDRLLAGTLEASIEIIKTSYRQRLDNFADYTLPKQLAFRQVDDTSLLPDYPYRDDALLLWQATETYVKDYLSLYYTSDADVNKDTELQAWVRKLMSPEGGGIKKLVSDGKLDTLAKLIEVVTQIIFIAGPQHAAVNYSQYDYLAFCANIPLAGYQSPPKASEEVDMDYILRLLPPQAQATYQLEIMHTLTAFQFNRFGYPSRNDFPDQRTYPILAVFQAKLKAIENEIDRRNSTRITPYIFLKPSRIPNSINI

SEQ ID NO: 147 - DNA, 1656 bp, Microcystis aeruginosa
  CDS (1)..(1656)
atgctgacaccatcgctacccaaaaatgatcctgatccagtcaaaagacaagatctattaagacgacaaaaacaagtgtacatttatgattccgttaatggtatcaccctcgtcaaagatttacctacccacgaaaacttttctatttcctatcaagtaatgcggggtaaaggtttcagtgctttaattgccaatggagtcgccacaagggtagaaaatatcttcgatccctttgacaaattagaagattacgaagaactttttcccatccttccccaacccacaagcattaaaacttggcaatctaacacaagttttgcctaccaaagattagcgggagcaaatcccatggtaatccgcgggattagcagcttaccaaataattttcccgtcagcgatgctatcttccaaaaagctatgggacccgataaaaccattgcctcggaagccgctaagggtaacttatttctagcagattatgcccccctacaccacctaactttaggcagttatcaaaggggtatgaaaactgtgacagcacctcttgtccttttctgttggcgtgctagaggtttacggggtcaagggggattagtaccagttgccattcaattgtatcaggatccgaccctacctaatcagcgcatctatacccccgatgacggacttaattggttaatggcgaaaattttcgtgcaaattgccgacggaaatcaccatgaattagttagtcacctcagccatacccatttagtagcggaagcttttgttttagccacagctaccgagttagcacttaatcatcctctggcaattctattaagacctcattttcaatttaccctcgctattaatagtttagccgagagcgagttaattaaccccggcggattcgttgatcgtctattagcggggaccctagaagcatctatcgagctaattaagagttcctatcgtcaaagattggataatttcgccgattatgccctaccaaagcaattagaattgcgccaggtccaggatacctccctactaccagattacccctaccgagacgatgctctcttactttggcaagcaacggaaacctacgtcaaagattacctaagtctttactatacttccgacgcggacgtaaacgaggatacagaattacaagcttgggcgcgaaaattgatgtcatctgaaggtggaggcatcaaaaaattagtttctgacggagaattagacactttagccaaattagtcgaagttgtcacccagataatttttgtggccggaccacaacacgcggcggttaattatcctcaatacgattatctcgcctttagccccaatattcccctagcgggttatcaatcccctcccaaagcagctgaggaagtggatatagattatattctccgtcttttgccgccccaggcccaggccgcttatcaattggaaattatgcagactttaacagcttttcaatttaaccgttttggttatccatcccgaagtgctttcccagatcaacgtgcttacccgattttggcggttttccaagctaaattaaaagcgatcgaaaatgagatcgatcggcgcaatttaacccgatttacgccttatattttcctgaaaccctctcgcatacccaatagtatcaatatttag

SEQ ID NO: 148 - protein, 551 aa, Microcystis aeruginosa
MLTPSLPKNDPDPVKRQDLLRRQKQVYIYDSVNGITLVKDLPTHENFSISYQVMRGKGFSALIANGVATRVENIFDPFDKLEDYEELFPILPQPTSIKTWQSNTSFAYQRLAGANPMVIRGISSLPNNFPVSDAIFQKAMGPDKTIASEAAKGNLFLADYAPLHHLTLGSYQRGMKTVTAPLVLFCWRARGLRGQGGLVPVAIQLYQDPTLPNQRIYTPDDGLNWLMAKIFVQIADGNHHELVSHLSHTHLVAEAFVLATATELALNHPLAILLRPHFQFTLAINSLAESELINPGGFVDRLLAGTLEASIELIKSSYRQRLDNFADYALPKQLELRQVQDTSLLPDYPYRDDALLLWQATETYVKDYLSLYYTSDADVNEDTELQAWARKLMSSEGGGIKKLVSDGELDTLAKLVEVVTQIIFVAGPQHAAVNYPQYDYLAFSPNIPLAGYQSPPKAAEEVDIDYILRLLPPQAQAAYQLEIMQTLTAFQFNRFGYPSRSAFPDQRAYPILAVFQAKLKAIENEIDRRNLTRFTPYIFLKPSRIPNSINI

SEQ ID NO: 149 - DNA, 1656 bp, Microcystis aeruginosa
  CDS (1)..(1656)
atgctgacaccatcgctccccaaaaatgatcctgatccagtcaaaagacaagatctattaagacgacaaaaacaagtgtacatttatgattccgttaatggtatcaccctcgtcaaagatttacctccccacgaaaacttttctatttcctatcaagtaatgcggggtaaaggtttcagtgctttaattgccaatggagtcgccacaagggtagaaaatatcttcgatccctttgacaaattagaagattacgaagaactttttcccatccttccccaacccacaagcattaaaacttggcaatctaacacaagttttgcctaccaaagattagcgggagcaaatcccatggtaatccgcgggattagcagcttaccaaataattttcccgtcagcgatgctatcttccaaaaagctatgggacccgataaaaccattgcctcggaagccgctaagggtaacttatttctagcagattatgcccccctacaccacctaactttaggcagttatcaaaggggtatgaaaactgtgacagcacctcttgtccttttctgttggcgtgctagaggtttacggggtcaagggggattagtaccagttgccattcaattgtatcaggatccgaccctacctaatcagcgcatctatacccccgatgacggacttaattggttaatggcgaaaattttcgtgcaaattgccgacggaaatcaccatgaattagttagtcacctcagccatacccatttagtagcggaagcttttgttttagccacagctaccgagttagcacttaatcatcctctggcaattctattaagacctcattttcaatttaccctcgctattaatagtttagccgagagcgagttaattaaccccggcggattcgttgatcgtctattagcggggaccctagaagcatctatcgagctaattaagagttcctatcgtcaaagattggataatttcgccgattatgccctaccaaagcaattagaattgcgccaggtccaggatacctccctactaccagattacccctaccgagacgatgctctcttactttggcaagcaacggaaacctacgtcaaagattacctaagtctttactatacttccgacgcggacgtaaacgaggatacagaattacaagcttgggcgcgaaaattgatgtcatctgaaggtggaggcatcaaaaaattagtttctgacggagaattagacactttagccaaattagtcgaagttgtcacccagataatttttgtggccggaccacaacacgcggcggttaattatcctcaatacgattatctcgcctttagccccaatattcccctagcgggttatcaatcccctcccaaagcagctgaggaagtggatatagattatattctccgtcttttgccgccccaggcccaggccgcttatcaattggaaattatgcagactttaacagcttttcaatttaaccgttttggttatccatcccgaagtgctttcccagatcaacgtgcttacccgattttggcggttttccaagctaaattaaaagcgatcgaaaatgagatcgatcggcgcaatttaacccgatttacgccttatattttcctgaaaccctctcgcatacccaatagtatcaatatttag

SEQ ID NO: 150 - protein, 551 aa, Microcystis aeruginosa
MLTPSLPKNDPDPVKRQDLLRRQKQVYIYDSVNGITLVKDLPPHENFSISYQVMRGKGFSALIANGVATRVENIFDPFDKLEDYEELFPILPQPTSIKTWQSNTSFAYQRLAGANPMVIRGISSLPNNFPVSDAIFQKAMGPDKTIASEAAKGNLFLADYAPLHHLTLGSYQRGMKTVTAPLVLFCWRARGLRGQGGLVPVAIQLYQDPTLPNQRIYTPDDGLNWLMAKIFVQIADGNHHELVSHLSHTHLVAEAFVLATATELALNHPLAILLRPHFQFTLAINSLAESELINPGGFVDRLLAGTLEASIELIKSSYRQRLDNFADYALPKQLELRQVQDTSLLPDYPYRDDALLLWQATETYVKDYLSLYYTSDADVNEDTELQAWARKLMSSEGGGIKKLVSDGELDTLAKLVEVVTQIIFVAGPQHAAVNYPQYDYLAFSPNIPLAGYQSPPKAAEEVDIDYILRLLPPQAQAAYQLEIMQTLTAFQFNRFGYPSRSAFPDQRAYPILAVFQAKLKAIENEIDRRNLTRFTPYIFLKPSRIPNSINI

SEQ ID NO: 151 - DNA, 1581 bp, Microcystis aeruginosa
  CDS (1)..(1581)
atgtacatttatgattccgttaatggtatcaccctcgtcaaagatttacctacccacgaaaacttttctatttcctatcaagtaatgcggggtaaaggtttcagtgctttaattgccaatggagtcgccacaagggtagaaaatatcttcgatccctttgacaaattagaagattacgaagaactttttcccatccttccccaacccacaagcattaaaacttggcaatctaacacaagttttgcctaccaaagattagcgggagcaaatcccatggtaatccgcgggattagcagcttaccaaataattttcccgtcagcgatgctatcttccaaaaagctatgggacccgataaaaccattgcctcggaagccgctaagggtaacttatttctagcagattatgcccccctacaccacctaactttaggcagttatcaaaggggtatgaaaactgtgacagcacctcttgtccttttctgttggcgtgctagaggtttacggggtcaagggggattagtaccagttgccattcaattgtatcaggatccgaccctacctaatcagcgcatctatacccccgatgacggacttaattggttaatggcgaaaattttcgtgcaaattgccgacggaaatcaccatgaattagttagtcacctcagccatacccatttagtagcggaagcttttgttttagccacagctaccgagttagcacttaatcatcctctggcaattctattaagacctcattttcaatttaccctcgctattaatagtttagccgagagcgagttaattaaccccggcggattcgttgatcgtctattagcggggaccctagaagcatctatcgagctaattaagagttcctatcgtcaaagattggataatttcgccgattatgccctaccaaagcaattagaattgcgccaggtccaggatacctccctactaccagattacccctaccgagacgatgctctcttactttggcaagcaacggaaacctacgtcaaagattacctaagtctttactatacttccgacgcggacgtaaacgaggatacagaattacaagcttgggcgcgaaaattgatgtcatctgaaggtggaggcatcaaaaaattagtttctgacggagaattagacactttagccaaattagtcgaagttgtcacccagataatttttgtggccggaccacaacacgcggcggttaattatcctcaatacgattatctcgcctttagccccaatattcccctagcgggttatcaatcccctcccaaagcagctgaggaagtggatatagattatattctccgtcttttgccgccccaggcccaggccgcttatcaattggaaattatgcagactttaacagcttttcaatttaaccgttttggttatccatcccgaagtgctttcccagatcaacgtgcttacccgattttggcggttttccaagctaaattaaaagcgatcgaaaatgagatcgatcggcgcaatttaacccgatttacgccttatattttcctgaaaccctctcgcatacccaatagtatcaatatttag

SEQ ID NO: 152 - protein, 526 aa, Microcystis aeruginosa
MYIYDSVNGITLVKDLPTHENFSISYQVMRGKGFSALIANGVATRVENIFDPFDKLEDYEELFPILPQPTSIKTWQSNTSFAYQRLAGANPMVIRGISSLPNNFPVSDAIFQKAMGPDKTIASEAAKGNLFLADYAPLHHLTLGSYQRGMKTVTAPLVLFCWRARGLRGQGGLVPVAIQLYQDPTLPNQRIYTPDDGLNWLMAKIFVQIADGNHHELVSHLSHTHLVAEAFVLATATELALNHPLAILLRPHFQFTLAINSLAESELINPGGFVDRLLAGTLEASIELIKSSYRQRLDNFADYALPKQLELRQVQDTSLLPDYPYRDDALLLWQATETYVKDYLSLYYTSDADVNEDTELQAWARKLMSSEGGGIKKLVSDGELDTLAKLVEVVTQIIFVAGPQHAAVNYPQYDYLAFSPNIPLAGYQSPPKAAEEVDIDYILRLLPPQAQAAYQLEIMQTLTAFQFNRFGYPSRSAFPDQRAYPILAVFQAKLKAIENEIDRRNLTRFTPYIFLKPSRIPNSINI

SEQ ID NO: 153 - DNA, 1656 bp, Microcystis aeruginosa
  CDS (1)..(1656)
atgctgacaccatcgctaccccaaaatgatcctgatccagccaaaagacaagagctattaagacgacaaaaacaagtgtacatctatgattccgttaatggtatcaccctcgtcaaagatttacctacccacgaaaacttttctatttcctatcaagtaatgcggggtaaaggtttcagtgctttaattgccaatggcgtggccacgagaatagaaaacgtctttgatcccttcgacaaattagaagattacgaagaactttttcccatccttccccaacccacaagcattaaaacttggcaatctaacacaagttttgcctaccaaagattagcgggagcaaatcccatggtcatccgcgggattagcagcttaccggataattttcccgtcagcgatgctatcttccaaaaagccatgggacctgataaaaccattgcctcggaagccgctaagggtaacttatttctagcagattatgcccccctaaacaacctaactttaggcagttatcaacgggggatgaaaactgtaacagcacctcttgtccttttctgttggcgtgctagaggtttacggggtcaagggggattagtaccagttgccattcaattgtatcaggagccgaccctacctaatcagcgcatctatacccccgacgacggacttaattggttaatggcgaagattttcgtgcaaattgccgatggaaaccaccatgaattagttagtcacctcagccatacccatttagtagcggaagcttttgttttagccacagctaccgagttagcacttaatcatcctctggcaattctattaagacctcattttcaatttaccctcgctattaatagtttagccgagagcgagttaattaaccccggcggattcgttgatcgtctattagcggggacgctagaagcatcgatcgagctaattaagagttcctatcgtcaaagattagataatttcgccgattatgccctaccaaagcaattagaattgcgccaagtccaggatacctcgctactaccagattacccctaccgagacgatgctctcttactttggcaagcaacggaaacctacgtcaaagattacctaagtctttactatacttccgatgcggacgtaaatgaggatacagaattacaagcttgggtgcgaacattgatgtcacctgaaggtggaggcatcaaaaaattagtttctgaaggagaattagacactttggccaaattaatcgaagttgtcacccagataatttttgtggccggaccacaacacgcggcggttaattatcctcaatacgattatctcgccttttgcccgaatattcccctagcgggttatcaatctcctcccaaagcagctgagcaggtggatatagattatattctccgtcttttgcccccccaggcccaggccgcttatcaattggaaattatgcagactttaacagcttttcaatttaaccgttttggctatccatcccgaagtgctttcccagatcaacgcacttacccgattttggcggttttccaagctaaattaaaggcgatcgaaaatcagatcgatcggcgcaatttaacccgatttacgccttatattttcctgaaaccctctcgcatccccaatagtatcaatatttag

SEQ ID NO: 154 - protein, 551 aa, Microcystis aeruginosa
MLTPSLPQNDPDPAKRQELLRRQKQVYIYDSVNGITLVKDLPTHENFSISYQVMRGKGFSALIANGVATRIENVFDPFDKLEDYEELFPILPQPTSIKTWQSNTSFAYQRLAGANPMVIRGISSLPDNFPVSDAIFQKAMGPDKTIASEAAKGNLFLADYAPLNNLTLGSYQRGMKTVTAPLVLFCWRARGLRGQGGLVPVAIQLYQEPTLPNQRIYTPDDGLNWLMAKIFVQIADGNHHELVSHLSHTHLVAEAFVLATATELALNHPLAILLRPHFQFTLAINSLAESELINPGGFVDRLLAGTLEASIELIKSSYRQRLDNFADYALPKQLELRQVQDTSLLPDYPYRDDALLLWQATETYVKDYLSLYYTSDADVNEDTELQAWVRTLMSPEGGGIKKLVSEGELDTLAKLIEVVTQIIFVAGPQHAAVNYPQYDYLAFCPNIPLAGYQSPPKAAEQVDIDYILRLLPPQAQAAYQLEIMQTLTAFQFNRFGYPSRSAFPDQRTYPILAVFQAKLKAIENQIDRRNLTRFTPYIFLKPSRIPNSINI

SEQ ID NO: 155 - DNA, 1653 bp, Microcystis aeruginosa
  CDS (1)..(1653)
atgataccatcgctaccccaaaatgatgctgattctatcaaacgacaagaattactacaaagacaaaaacaagtctacatctatgattccgttagtggtatcaccctcgtcaaagatttacctgcccaagaaaatttctctatttcctatcaattaatgctgcgtaaaggcttgagtgctttaattgccaatagcgtggccacgaaaatagaaaatgtctttgatccctttgacaaattagaagattacgaacaactttttcctctccttcccaaacccacaagtattaaaacttggcaatctaacacaagttttgcctaccaaagattagcgggattaaatcccatggtcatccgcgggattagcagcataccggataatttccccgtcagcgatgctatcttccaaaaagccatgggacccgataaaaccattgcctcggaagccgctaagggtaacttatttctagcagattatgcccccctaaacaacctaactttaggcagttatcaaaggggtatgaaaaccgcaacagcacctcttgtccttttctgttggcgtgctaggggtttacggggtcaagggggattagtaccggttgccattcaattgtatcaggatccgaccgtacctaatcagcgcatctatacccccgatgacggacttaattggttaatggcgaagattttcgtgcaaattgccgacggaaatcaccatgaattagttagtcatctcagccatacccatttagtagcggaagcttttgttttagccacagctaccgagttagcactcaatcatcctctggcaattctattaaaacctcattttcaatttaccctcgctattaatactttagccgagagcgagttaattagcccaggcggattcgttgatcgtctattagcggggacgctagaagcatctatcgagataattaagacttcctatcgtcaaagattggataatttcgccgattataccctacccaagcaattagccttccgccaagtcgatgatacctcccgactaccagattacccctaccgggacgatgctctcttactttggcaagcaacggaaacctacgtcaaagattacctaagtctttactatacttccgacgcggatgtaaacgaggatacagaattacaagcttgggtgcgaaaattgatgtcacctgaaggtggaggcattaaaaaattagtttctgacggaaaattagacactttagccaaattaatcgaagttgtcacccagataatttttattgctggaccacaacacgcggcggttaattattctcaatacgattatctcgccttttgcgcgaatattcccctagccggttatcaatctcctcccaaagcatctgaggaggtggatatggattatattctccgtcttttgcccccccaggcccaggccacttatcaattggaaattatgcacactttaacagcttttcaattcaaccgttttggttatccatcccgaaatgatttcccagatcaacgcacttacccgattttggcggttttccaagctaaattaaaagcgatcgaaaatgagatcgatcggcgcaattcaacccgaattacgccttatattttcctgaaaccctctcgcatccccaatagtatcaatatttag

SEQ ID NO: 156 - protein, 550 aa, Microcystis aeruginosa
MIPSLPQNDADSIKRQELLQRQKQVYIYDSVSGITLVKDLPAQENFSISYQLMLRKGLSALIANSVATKIENVFDPFDKLEDYEQLFPLLPKPTSIKTWQSNTSFAYQRLAGLNPMVIRGISSIPDNFPVSDAIFQKAMGPDKTIASEAAKGNLFLADYAPLNNLTLGSYQRGMKTATAPLVLFCWRARGLRGQGGLVPVAIQLYQDPTVPNQRIYTPDDGLNWLMAKIFVQIADGNHHELVSHLSHTHLVAEAFVLATATELALNHPLAILLKPHFQFTLAINTLAESELISPGGFVDRLLAGTLEASIEIIKTSYRQRLDNFADYTLPKQLAFRQVDDTSRLPDYPYRDDALLLWQATETYVKDYLSLYYTSDADVNEDTELQAWVRKLMSPEGGGIKKLVSDGKLDTLAKLIEVVTQIIFIAGPQHAAVNYSQYDYLAFCANIPLAGYQSPPKASEEVDMDYILRLLPPQAQATYQLEIMHTLTAFQFNRFGYPSRNDFPDQRTYPILAVFQAKLKAIENEIDRRNSTRITPYIFLKPSRIPNSINI

SEQ ID NO: 157 - DNA, 1653 bp, Microcystis aeruginosa
  CDS (1)..(1653)
atgataccatcgctaccccaaaatgatgctgattctatcaaacgacaagaattactacaaagacaaaaacaagtgtacatctatgattatgttagtggtatcaccctcgtcaaagatttacctgcccaagaaaatttctctatttcctatcaattaatgctgcgtaaaggcttgagtgctttaattgccaatggcgtggccacgagaatagaaaatgtctttgatccctttgacaaattagaagattacgaacaactttttcctatccttcccaaacccacaagtattaaaacttggcaatctaacacaggttttgcctaccaaagattagcgggaacaaatccaatggtcatccgcgggattagcagcttaccagataatttccccgtcagcgatgctatcttccaaaaagcgatgggaccggataaaaccattgcctcggaagccgctaagggtaacttatttctagcagattatgcccccctaaacaacctaactttaggcagttatcaacgggggatgaaaactgtgacagcacctcttgtccttttctgttggcgtgctagaggtttacgcggtcaagggggattagtaccagttgccattcaattatatcaagatccgaccctacctaatcagcgcatctatacccccgacgacggacttaattggttaatggcgaagattttcgtgcaaattgccgacggaaatcatcatgaattagttagtcacctcagccatacccatttagtagcggaagcttttgttttagccacagctaccgagttagcactcaatcatcctctggcaattctattaaaacctcattttcaatttaccctcgctattaatactttagccgagaacgagttaattagcccaggcggattcgttgatcgtctattagcggggacgctagaagcatctatcgagataattaagacttcctatcgtcaaagattggataatttcgccgattataccctacccaagcaattagccttccgccaagtcgatgacacctccctactaccagattacccctaccgagacgatgctctcttactttgggaagcaacggaaacctacgtcaaagattacctaagtctttactatacttccgacgcggatgtaaacgaggatacagaattacaagcttgggtgcgaaaattgatgtcacctgaaggtggaggcattaaaaaattagtttctgacggaaaattagacactttagccaaattaatcgaagttgtcacccagataatttttattgctggaccacaacacgcggcggttaattattctcaatacgattatctcgccttttgcgcgaatattcccctagccggttatcaatctcctcctaaagcagctgaggaggtggatatggattatattctccgtcttttgcccccccaggcccaggccacttatcaattggaaattatgcacactttaacagcttttcaattcaaccgttttggttatccatcccgaaatgatttcccagatcaacgcacttacccgattttggcggttttccaagctaaattaaaagcgatcgaaaatgagatcgatcggcgcaattcaacccgaattacgccttatattttcctgaaaccctctcgcatccccaatagtattaatatttaa

SEQ ID NO: 158 - protein, 550 aa, Microcystis aeruginosa
MIPSLPQNDADSIKRQELLQRQKQVYIYDYVSGITLVKDLPAQENFSISYQLMLRKGLSALIANGVATRIENVFDPFDKLEDYEQLFPILPKPTSIKTWQSNTGFAYQRLAGTNPMVIRGISSLPDNFPVSDAIFQKAMGPDKTIASEAAKGNLFLADYAPLNNLTLGSYQRGMKTVTAPLVLFCWRARGLRGQGGLVPVAIQLYQDPTLPNQRIYTPDDGLNWLMAKIFVQIADGNHHELVSHLSHTHLVAEAFVLATATELALNHPLAILLKPHFQFTLAINTLAENELISPGGFVDRLLAGTLEASIEIIKTSYRQRLDNFADYTLPKQLAFRQVDDTSLLPDYPYRDDALLLWEATETYVKDYLSLYYTSDADVNEDTELQAWVRKLMSPEGGGIKKLVSDGKLDTLAKLIEVVTQIIFIAGPQHAAVNYSQYDYLAFCANIPLAGYQSPPKAAEEVDMDYILRLLPPQAQATYQLEIMHTLTAFQFNRFGYPSRNDFPDQRTYPILAVFQAKLKAIENEIDRRNSTRITPYIFLKPSRIPNSINI

SEQ ID NO: 159 - DNA, 1656 bp, Microcystis aeruginosa
  CDS (1)..(1656)
atgatgataccatcgctcccaaaaaatgatcctgatccagtcaaaagacaagatctattaagacgacaaaaacaagtgtacatttatgattccgttaatggtatcaccctcgtcaaagatttacctacccacgaaaacttttctatttcctatcaagtaatgcggggtaaaggtttcagtgctttaattgccaatggagtcgccacaagggtagaaaatatcttcgatccctttgacaaattagaagattacgaacaactttttcctatccttccccaacccacaagcattaaaacttggcaatctaacacaagttttgcctaccaaagattagcgggagcaaatcccatggtaatccgcgggattagcagcttaccaaataattttcccgtcagcgatgccatcttccaaaaagccatgggacccgataaaaccattgcctcggaagccgctaagggtaacttatttctagcagattatgcccccctacaccacctaactttaggcagttatcaaagggggatgaaaactgtgacagcacctcttgtccttttctgttggcgtgctagaggtttacggggtcaagggggattagtaccagttgccattcaattgtatcaggatccgaccctacctaatcagcgcatctatacccccgatgacggacttaattggttaatggcgaaaattttcgtgcaaattgctgacggaaatcaccatgaattagttagtcacctcacccatacccatttagtagcggaagcttttgttttagccacagctaccgagttagcacttaatcatcctctggcaattctattaagacctcattttcaatttaccctcgctattaatagtttagccgagagcgagttaattaaccccggcggattcgttgatcgtctattagcggggacgctagaagcatctatcgagctaattaagagttcctatcgtcaaagattggataatttcgccgattataccctaccaaaggaattagaattgcgccaagtccaggatacctcgctactaccagattacccctaccgagacgatgctctcttactttggcaagcaacggaaacctacgtcaaagattacctaagtctttactatacttccgacgcggacgtaaacgaggatacagaattacaagcttgggtgcgaacattgatgtcacctgaaggtggaggcatcaaaaaattagtttctgacggagaattagacactttagccaaattagtcgaagttgtcacccagataatttttgtggccggaccacaacacgcggcggttaattatcctcaatacgattatctcgcctttagccccaatattcccctagcgggttatcaatcccctcccaaagcagctgaggaagtggatatagattatattctccgtcttttgccgccccaggcccaggccgcttatcaattggaaattatgcagactttaacagcttttcaatttaaccgttttggttatccatcccgaagtgctttcccagatcaacgtgcttacccgattttggcagttttccaagctaaattaaaagcgatcgaaaatgagatcgatcggcgcaatttaacccgatttacgccttatattttcctgaaaccctctcgcatacccaatagtatcaatatttga

SEQ ID NO: 160 - protein, 551 aa, Microcystis aeruginosa
MMIPSLPKNDPDPVKRQDLLRRQKQVYIYDSVNGITLVKDLPTHENFSISYQVMRGKGFSALIANGVATRVENIFDPFDKLEDYEQLFPILPQPTSIKTWQSNTSFAYQRLAGANPMVIRGISSLPNNFPVSDAIFQKAMGPDKTIASEAAKGNLFLADYAPLHHLTLGSYQRGMKTVTAPLVLFCWRARGLRGQGGLVPVAIQLYQDPTLPNQRIYTPDDGLNWLMAKIFVQIADGNHHELVSHLTHTHLVAEAFVLATATELALNHPLAILLRPHFQFTLAINSLAESELINPGGFVDRLLAGTLEASIELIKSSYRQRLDNFADYTLPKELELRQVQDTSLLPDYPYRDDALLLWQATETYVKDYLSLYYTSDADVNEDTELQAWVRTLMSPEGGGIKKLVSDGELDTLAKLVEVVTQIIFVAGPQHAAVNYPQYDYLAFSPNIPLAGYQSPPKAAEEVDIDYILRLLPPQAQAAYQLEIMQTLTAFQFNRFGYPSRSAFPDQRAYPILAVFQAKLKAIENEIDRRNLTRFTPYIFLKPSRIPNSINI

SEQ ID NO: 161 - DNA, 1749 bp, Gammaproteobacteria bacterium 42_54_T18
  CDS (1)..(1749)
atggtcggtcacgatgggccgaaatacgcacacgaatcaaatcaaccttcattgccacaaaacgataccccagcagagcaagaggctcgccgtactgcattgggattaactcaagaaaaataccatttgagcaacgacaatgacctgggcttaccgctactgaaggaagtcccagcagaggaagccttcagcaatatttacgaagccggtcgcgcaattgacacttttcccttgttagagaaccatgacaaggtaatgtcgcagctaacaaatccctatggtcccttcacaggattggctgattacgaaagtatgtttattgatatcccaaagccggctgttaccaaaaattggttaacagacgaaagttttggtgagcagcgcctttctggtgttaatcccgtaatgatagagcgcgtgaaaaatgcaaaagatttggcctccaagtttaatgtcagccaattgaaagatgtcttggatagcgacataaacttggatgaactcataaaagatgagctattgtacattacggacctatccccctatctaaaggatattcctgaaggtaaagtaccctccccgggcggctacattccaaaatatttaccaaaacccatcggtttattttactggcataaagatggtgcaaaattaaaggacccctctttaaaatcgggccgattgttacctctcgccattcaggttgaccttgaaggtgaccaagtaaaaatacttacgccaaaaagcccagagttactttggacaattgccaaaatgtgcttctctattgccgatgtcaatgtccatgaaatgtcgactcacttagggcgggcacattttgcccaagaatcctttggagcgattaccccctgtcaactagcgcctaaacacccactagcaattttactaaaaccccatctgcgttttctggtggctaataatcaagccggtattgaaaaacttgtgaacacaggtggccccgtagacatgctgttagcttcaaccctacaggggtcgctagatataagtactactgcggcgaaatcttggtcagtgacagaaacattccccgaatcaatacaagcaagaaatgttgcttcagaggaatcgttaccccattacccttatcgggacgatggtattttgatatgggatgctgtggttggttacgttaacgaatacgtcaatatctattataaaaatgaagaagatgtagtgaaggattatgaattgcaggcatgggctaaaaacttagcagataccggcgtccacggtggaaacatcaaagatatgccgagccagatagagagtatcaaacaactatcacaactcctttctgtcatcattttccataatagtgccggacatagttctatcaattacccacaatatccctgtataggtttttgccctaatatgcctttagcgggttatagcaattaccgtgaattcctggctaaggagaaaacaacacaagaggagcagctcacctttttactaagcttcgcaccaccccaagcattagccttagggcagatcgatatcacaaactctctgtccatttatcattatgatactttgggcgattatgcaaaagagttaaccgaccctttggcaaaacacgctctatactgtttcactcaaaaattgacagctattgaacaacagattgaggtcagaaacagtcaacgggccgagccttataagtacatgttgccgtctgaaattttgaatagcgccagcatttaa

SEQ ID NO: 162 - protein, 582 aa, Gammaproteobacteria bacterium 42_54_T18
MVGHDGPKYAHESNQPSLPQNDTPAEQEARRTALGLTQEKYHLSNDNDLGLPLLKEVPAEEAFSNIYEAGRAIDTFPLLENHDKVMSQLTNPYGPFTGLADYESMFIDIPKPAVTKNWLTDESFGEQRLSGVNPVMIERVKNAKDLASKFNVSQLKDVLDSDINLDELIKDELLYITDLSPYLKDIPEGKVPSPGGYIPKYLPKPIGLFYWHKDGAKLKDPSLKSGRLLPLAIQVDLEGDQVKILTPKSPELLWTIAKMCFSIADVNVHEMSTHLGRAHFAQESFGAITPCQLAPKHPLAILLKPHLRFLVANNQAGIEKLVNTGGPVDMLLASTLQGSLDISTTAAKSWSVTETFPESIQARNVASEESLPHYPYRDDGILIWDAVVGYVNEYVNIYYKNEEDVVKDYELQAWAKNLADTGVHGGNIKDMPSQIESIKQLSQLLSVIIFHNSAGHSSINYPQYPCIGFCPNMPLAGYSNYREFLAKEKTTQEEQLTFLLSFAPPQALALGQIDITNSLSIYHYDTLGDYAKELTDPLAKHALYCFTQKLTAIEQQIEVRNSQRAEPYKYMLPSEILNSASI

SEQ ID NO: 163 - DNA, 1710 bp, Chamaesiphon polymorphus
  CDS (1)..(1710)
atgctccaaccgagtttgccccaagacgataccctcgatcgacagcagcagcgaaatcaggcgatcgcgcagcagcgagaagattatcaatatagccagacagccgggatcctgctaattaaagagttgccccagtcggaaatgttttcactcaaatacttattggagcgagatgctgggttagtatctttaattgcaaatactttggcaagcagtatcgaaaatgtcttcgatcccttcgataaattagaagattatcaggagatgtttccactgttacccaaaccctcggtctgggaaacattccgcaatgatgctgtttttgcccgtcagcgtattgctggtgccaacccgatggtaatcgagcgtgtaattgacaagttgcccgataactttccagttacagatgccatattccaaaaaatcatgttaactaaaaaaactctggcagaggcaattgctgagggaagaatcttcctcaccaattatcaagggctggatggactcaagccaggaggctaccaatacgaacgggatggacaacaagttaaagtaacaaaaactattgccgcgcccttagtattgtactgctggaaacccacaggttatggagattatcgtggtaatttagcaccgatcgccattcaaatcaatcagcaacccgatccgatcgccaatccaatttataccccaagagacggaaggcattggttgatggcaaaaatctttgctcagatggctgatggaaactatcacgaagctatcagtcatctaggccgaactcatttggtattagaaccttttgtgttagcaaccgccaatgaattagccccaaatcatcccctttcagttctgctcaaaccccattttcaatttaccctagcaatcaacgaactagcccgagaacaattgattagcccaggcggttatgcagacgatttgctagccggaactctagaagcctcgatcggtgtaattaaagcagccatcaaagaatacctagaaaacttcactgagtttgccatacctaaagaactcacccggcgaggagtaggggaaaccgatgtggatggatcgggagaaaattttttgccagactacccctatagagatgatgctctactattgtggaacgcaattaaagtttacgtcagtgattatctaaacctctactacacgtcttcagccaagattattggcgatccggaactacagaattgggcgaaaaagctgatttctccagaggggggtaatgtcacgggtttagttcccaatggtcaactgacaacgctagaacaacttgtcgagatcgtcacccaattaatttttgtcagtggccctcaacatggtgcggtgaactatcctcagtatgactatatggcatttgtacccaatatcccgctggctacctatggaaatccgcccagccgcgatgtggaaattaatgaggagaccattttaaatattctgccaccacaaaagttggcagccaagcaactggaattgatgagaactctctctgttttccgggcaaatcgtttagggtatccagatcgagaattcgtcgatgttcgcgctcggggagtgttgcagaaatttcaagcaagattgcaagaaatcgaacaagaaatttcggtacggaatgaaactcgactcgaaccatatctatttctcttgccctccaatgtgccaaatagtttaaatatttaa

SEQ ID NO: 164 - protein, 569 aa, Chamaesiphon polymorphus
MLQPSLPQDDTLDRQQQRNQAIAQQREDYQYSQTAGILLIKELPQSEMFSLKYLLERDAGLVSLIANTLASSIENVFDPFDKLEDYQEMFPLLPKPSVWETFRNDAVFARQRIAGANPMVIERVIDKLPDNFPVTDAIFQKIMLTKKTLAEAIAEGRIFLTNYQGLDGLKPGGYQYERDGQQVKVTKTIAAPLVLYCWKPTGYGDYRGNLAPIAIQINQQPDPIANPIYTPRDGRHWLMAKIFAQMADGNYHEAISHLGRTHLVLEPFVLATANELAPNHPLSVLLKPHFQFTLAINELAREQLISPGGYADDLLAGTLEASIGVIKAAIKEYLENFTEFAIPKELTRRGVGETDVDGSGENFLPDYPYRDDALLLWNAIKVYVSDYLNLYYTSSAKIIGDPELQNWAKKLISPEGGNVTGLVPNGQLTTLEQLVEIVTQLIFVSGPQHGAVNYPQYDYMAFVPNIPLATYGNPPSRDVEINEETILNILPPQKLAAKQLELMRTLSVFRANRLGYPDREFVDVRARGVLQKFQARLQEIEQEISVRNETRLEPYLFLLPSNVPNSLNI

SEQ ID NO: 165 - DNA, 1686 bp, Nostoc linckia
  CDS (1)..(1686)
atgacacagccaagtttgccccaagatgatagccctgagcaacagttacagcgaaagcaagagattgcacgtcaacgggaagattatcaatatagcgaaacagcgggaatacttttgattaaagaattgccacagtcagaaatgttttcatttaaatatttactggagcgagataaaagtttaatatcattaatcgccaatactttggcaactaatattgataatgttttcgatcccttcgatagtttagaagactatcaacagatgtttccactgctgcccaaaccttcgacattgcaaacattccgcaacgatggtgtttttgctcgtcagcgcattgctggtgctaacccgatggtaattgaacgggtagtgggaaaattacccgataacttcgcagttacagatgccatctttcaaaaaattatgctaactcaaaagacgttagcacaggcgatcgcagagggcagaattttcatcaccaattatcaggggcttgatggactcactccaggaacctacgaacaaggaacaaaaaccattgctgctcccttggtgttgtactgctggaaacccgtaggttatggagattatcgcggaagtttgactccaattgccattcaactcaatcagcaaccccatccagaaaacaatccaatttatacaccaatggatggaatgcattggtttatggcaaaaatctatgctcagatggctgatggcaactatcatgaagctatcagccatctgggacgaactcatttggtattagagccatttgtcttagcaactgccaatgaactagcacctaatcatcctctttcagtgttgctaaaaccccattttcaattcaccctagcaatcaatgaactggcacgggaacaattgatcagcccaggtggctacgcagataccttgctagctggaaccctggaagcctccatcagcgttattaaagcagctattaaagaatatctggaaaacttcagtgactttgccttgcccaaggaattaactaggcgaggagtgggggaaaccgatgtggatggacagggagaaaactttttgccggactacccctatcgggatgatggtttgctattgtggaaagcaattgaggcttacgttagcaattatttagatctctattacacatctccagtccagattattaaggatacagaactacagaattgggtgcaaaagttaatatctccagaggggggtggtgtcaaaggattagtgcccaatggtcaattgcaaactgtggaacagttagtggccatcgccacccaactaatttttatcagtgggcctcagcatggtgcggtgaactatccccaatacgactaccttgccttcgtacccaatatgccgttagctacttatgcaccacctcccagccgcgatcgagaaattaatgaagccacaatcctgaagattctccccccacaaaagctggcagcaaagcaattagagttgatgagaactctcactgttttccaaccaaatcgcttgggctatccagacaagaactttgtcgatgtccgcgctcagaatgttttgcggcaattccaggcaaaattacaagaagttgagcaagtgattaatcagcgaaatcagacccgccttgaaccttatacctttcttttaccctcgaatgtacctaatagcttaaatatttag

SEQ ID NO: 166 - protein, 561 aa, Nostoc linckia
MTQPSLPQDDSPEQQLQRKQEIARQREDYQYSETAGILLIKELPQSEMFSFKYLLERDKSLISLIANTLATNIDNVFDPFDSLEDYQQMFPLLPKPSTLQTFRNDGVFARQRIAGANPMVIERVVGKLPDNFAVTDAIFQKIMLTQKTLAQAIAEGRIFITNYQGLDGLTPGTYEQGTKTIAAPLVLYCWKPVGYGDYRGSLTPIAIQLNQQPHPENNPIYTPMDGMHWFMAKIYAQMADGNYHEAISHLGRTHLVLEPFVLATANELAPNHPLSVLLKPHFQFTLAINELAREQLISPGGYADTLLAGTLEASISVIKAAIKEYLENFSDFALPKELTRRGVGETDVDGQGENFLPDYPYRDDGLLLWKAIEAYVSNYLDLYYTSPVQIIKDTELQNWVQKLISPEGGGVKGLVPNGQLQTVEQLVAIATQLIFISGPQHGAVNYPQYDYLAFVPNMPLATYAPPPSRDREINEATILKILPPQKLAAKQLELMRTLTVFQPNRLGYPDKNFVDVRAQNVLRQFQAKLQEVEQVINQRNQTRLEPYTFLLPSNVPNSLNI

SEQ ID NO: 167 - DNA, 1710 bp, Cyanothece sp. PCC 8801
  CDS (1)..(1710)
atggtacaaccaagtttaccccaagatgatacccccgatcaacaggagcagcgaaatcgggcaatcgcacagcaacgagaagcgtatcaatatagcgagacagccgggatactgttgatcaaaaccttgcctcagtcggaaatgttttcattgaaatacttgattgagcgagataagggattagtgtccctaattgccaataccttagccagcaatatcgagaatatcttcgatcccttcgataaattagaagattttgaggaaatgtttccattgttacccaaacctctagtaatgaacaccttccgcaatgatagggtgtttgctcgtcagcgtattgctggtcctaatccgatggttattgagcgggtcgttgacaaattgccagataacttccctgtgacggatgcgatgtttcaaaaaatcatgttcacgaaaaagactctagcagaggcaattgcacaagggaaactctttatcactaattacaaaggattggcggagctttcaccaggacgctatgaatatcaaaaaaatggaacactcgtccaaaaaaccaaaacgatcgcggctccgttagtattatacgcctggaaacctgaaggattcggcgattatcgggggagtttagcaccgatcgccattcaaatcaatcagcaacctgacccaataaccaatcccatttatacgccaagggatgggaagcattggtttatagcaaaaatctttgcccagatggctgatggcaattgtcacgaagcaattagccacttagcacgaacccatctgatcttagaaccttttgtgctggcaacggccaatgaactcgcaccaaatcatcctttatctgttctgcttaaaccccatttccaatttaccttggccattaatgaactggcacgagaacagttgatcagtgccggaggttatgccgatgatctgctcgctggaacccttgaagcctctatcgctgtcattaaagcggctatcaaggaatatatggacaatttcactgagtttgctttgcctcgtgagcttgctcgccgaggagtggggataggggatgtagatcaaaggggagaaaacttcttgccggactacccctatcgagatgacgcgatgctcttgtggaatgcgatcgaggtttatgtgagggattatctcagtctttactatcaatctcccgtccagattcgtcaagatacagaactgcaaaattgggttaggcgactggtgtccccagaagggggtagggtcacgggattagtgtccaatggggaactgaatacaattgaggcattggtggcgatcgcaactcaggtcatttttgtcagtggtcctcagcacgctgcggttaactatccccaatacgactatatggcgtttattcctaatatgcccctagctacctatgccactccccctaataaggagagcaacattagtgaagcaacaatcctcaatattcttcctccacaaaagttggcagcaaggcaactggagttgatgagaacgctgtgtgttttctatcccaatcgtttaggatatcccgacacagaatttgtggatgttcgggctcagcaggtgctgcatcaatttcaagaaagattgcaggaaattgaacaaaggatcgtcctatgcaatgaaaaacgactggaaccctatacttacctcttaccttcaaacgtccctaacagtaccagtatttaa

SEQ ID NO: 168 - protein, 569 aa, Cyanothece sp. PCC 8801 [sequence omitted]

SEQ ID NO: 169 - DNA, 1683 bp, Neosynechococcus sphagnicola
  CDS (1)..(1683)
atgctcccaccgagtttgccccaagatgatactcctgatcagcagctacagcgaaatcaggcgatcgcgcaacagcgagaagactatcaatatagccagactgcgggaatactactaattaaaacgttgcctcaatcggaaatgttttcattcaaatatttgctagagcgcgataaggggctggtttccttaattgtgaataccctagcaagcaaaatcgagaatatcttcgatcccttcgagaaattagaagattatcaggagatgtttccactgttgcccaaaccctcagttctagaaaccttccgacatgatgctgtctttgcccgtcaacgcattgcgggtgcaaacccgatggtcattgagcgcgtaattagcaaattaccggataacttcccggtcacagatgccatgtttcaaaaaattatgtcaaccaaaaagacgttggcagaggcgatcgctgaagggagactcttcctcacgaactataaggggctggatggactgaccccaggacactacgaaagaggaacaaaaaccattgcagctcccttagtcttgtactgctggaaaccaacaggttatggtgattatcgcgggaatttagcaccgatcgccattcaaattaatcagaaacctgacccgataatcaatccaatatataccccaagggatgggatgcattggtttatggcaaaaatctttgcccagatggcagatggcaactatcacgaagcgatcagtcatctaggtcgaacgcatctagttttagaaccatttgtgctggccaccgccaatgagctagcccccaatcatcctctttccattctcctcaagccccattttcaattcactctggcaatcaatgaactagcacgagaacaattgatcagcaaaggtggctatgcagatacgctgctcgcgggcacactggaagcctccatcagcgtcattaaagcagccatccaggaatacttcgaaaactttacagagtttgcagtaccgaaagagctaacccggcgaggcattggggaaaccgatttagatgcacagggcgagaatttcttacccgactacccctaccgagatgatgcactgttattgtgggatgcaattaaaaactacgtaagggattatctgaatctctactatacgtcccaagacaaaatcctcaaggataccgaactaaagaattgggtgagtaagcttatttctcctgaggggggaaatgtcaaaggattggttcccaatggtgagcttaccaccctagatcagttagttgagatagcaacgcagctaatttttgtcagtggcccacaacacgctgcggtgaattatccccaatacgactacatggcctttgtccctaacatgcccctagctacctatgcccctccgagtagcgatccgacgatcgatgaaaccacgattctgaaaattcttcctccacaaaaactagccgcaaagcaattagagctaatgaaaactctttctgtttttcgggcaaatcgcttaggctatccagacaatgaatttgttgatgttcgggctcagaatgtattaattaaatttcagggaaatttgaaaaaagtcgaggataaaattaccgcacggaatgagactcgacttgagccgtatgtatttctcttgccctccaacgtacctaatagtacaaatatttag

SEQ ID NO: 170 - protein, 560 aa, Neosynechococcus sphagnicola
MLPPSLPQDDTPDQQLQRNQAIAQQREDYQYSQTAGILLIKTLPQSEMFSFKYLLERDKGLVSLIVNTLASKIENIFDPFEKLEDYQEMFPLLPKPSVLETFRHDAVFARQRIAGANPMVIERVISKLPDNFPVTDAMFQKIMSTKKTLAEAIAEGRLFLTNYKGLDGLTPGHYERGTKTIAAPLVLYCWKPTGYGDYRGNLAPIAIQINQKPDPIINPIYTPRDGMHWFMAKIFAQMADGNYHEAISHLGRTHLVLEPFVLATANELAPNHPLSILLKPHFQFTLAINELAREQLISKGGYADTLLAGTLEASISVIKAAIQEYFENFTEFAVPKELTRRGIGETDLDAQGENFLPDYPYRDDALLLWDAIKNYVRDYLNLYYTSQDKILKDTELKNWVSKLISPEGGNVKGLVPNGELTTLDQLVEIATQLIFVSGPQHAAVNYPQYDYMAFVPNMPLATYAPPSSDPTIDETTILKILPPQKLAAKQLELMKTLSVFRANRLGYPDNEFVDVRAQNVLIKFQGNLKKVEDKITARNETRLEPYVFLLPSNVPNSTNI

SEQ ID NO: 171 - DNA, 1710 bp, Cyanothece sp. PCC 8802
  CDS (1)..(1710)
atggtacaaccaagtttaccccaagatgatacccccgatcaacaggagcagcgaaatcgggcaatcgcacagcaacgagaagcgtatcaatatagcgagacagccgggatactgttgatcaaaaccttgcctcagtcggaaatgttttcattgaaatacttgattgagcgagataagggattagtgtccctaattgccaataccttagccagcaatatcgagaatatcttcgatcccttcgataaattagaagattttgaggaaatgtttccattgttacccaaacctctagtaatgaacaccttccgcaatgatagggtgtttgctcgtcagcgtattgctggtcctaatccgatggttattgagcgggtcgttgacaaattgccagataacttccctgtgatggatgcgatgtttcaaaaaatcatgttcacgaaaaagactctagcagaggcaattgcacaagggaaactctttatcactaattacaaaggattggcggagctttcaccaggacgctatgaatatcaaaaaaatggaacactcgtccaaaaaaccaaaacgatcgcggctccgttagtattatacgcctggaaacctgaaggattcggcgattatcgggggagtttagcaccgatcgccattcaaatcaatcagcaacctgacccaataaccaatcccatttatacgccaagggatgggaagcattggtttatagcaaaaatctttgcccagatggctgatggcaattgtcacgaagcaattagccacttagcacgaacccatctgatcttagaaccctttgtgctggcaatggccaatgaacttgcaccaaatcatcctttgtctgttctgcttaaaccccatttccaatttaccttggctattaatgaactggcacgagaacagttgatcagtgccggaggttatgccgatgctctgctggctggaacccttgaagcctctatcgctgtcattaaagcggccatcaaggaatatatggacaatttcactgagtttgctttgcctcgggagcttgctcggcgaggagtgggggtagcagatgtggatcaaacgggagaaaacttcttgccggactacccctatcgagatgatgcgatgttattgtggaatgcgatcgaggtttatgtgagggattatttaagtctttactatcaatctcctgtccaaattcgtcaagatacagaactacaaaattgggttaggcgactggtgtctccagaagggggtagcgtcacgggattagtgcccaatggggaactgaatacaattgagcaactggtggcgatcgcaactcaggtcatttttgtcagtggtcctcagcacgctgcggtcaactatccccaatacgactatatggcgtttattcccaatatgcccctagctacctatgccactccccctcataaagatagcaacattagtgaagcaaccatcctcaatattcttcctccacaaaagttggcagcaaggcaactggagttgatgagaacgctgtgtgttttctatcccaatcgtttaggatatccagacacagaatttgtagatgtccgtgcgcagagggtgctgcatcaatttcaagaaagattgcaggaaattgaacaaaggatcgtcctatgcaatgaaaaacgactggaaccgtatacttacctcttaccttcaaatgtccctaacagtaccagtatttag

SEQ ID NO: 172 - protein, 569 aa, Cyanothece sp. PCC 8802
MVQPSLPQDDTPDQQEQRNRAIAQQREAYQYSETAGILLIKTLPQSEMFSLKYLIERDKGLVSLIANTLASNIENIFDPFDKLEDFEEMFPLLPKPLVMNTFRNDRVFARQRIAGPNPMVIERVVDKLPDNFPVMDAMFQKIMFTKKTLAEAIAQGKLFITNYKGLAELSPGRYEYQKNGTLVQKTKTIAAPLVLYAWKPEGFGDYRGSLAPIAIQINQQPDPITNPIYTPRDGKHWFIAKIFAQMADGNCHEAISHLARTHLILEPFVLAMANELAPNHPLSVLLKPHFQFTLAINELAREQLISAGGYADALLAGTLEASIAVIKAAIKEYMDNFTEFALPRELARRGVGVADVDQTGENFLPDYPYRDDAMLLWNAIEVYVRDYLSLYYQSPVQIRQDTELQNWVRRLVSPEGGSVTGLVPNGELNTIEQLVAIATQVIFVSGPQHAAVNYPQYDYMAFIPNMPLATYATPPHKDSNISEATILNILPPQKLAARQLELMRTLCVFYPNRLGYPDTEFVDVRAQRVLHQFQERLQEIEQRIVLCNEKRLEPYTYLLPSNVPNSTSI

SEQ ID NO: 173 - DNA, 1875 bp, Pseudanabaena sp. SR411
  CDS (1)..(1875)
atgatcttctcgcttttgagtggtgttgccagaatattaaattttgtcgcggcgaagttagtagacttagctgattggatatcaaggcgatcgccttccagcaagtatccactgctgccccagaatgatcctgaaataaatcagcgtcaagcatttctcaataatgccagacaactttaccaatacaactatacttacatcgactcgttgccaatggtggagacagttcccaccattgagagattctctttatcttggggtttactcgttggcaaagctgtagtcacggttttgctgaatgaaagagctaatctatcattggaaaaagataaactagcttctcaagccaagcaacgagaattttcaaaacgtttattagaggctggaatgtctcactcagacacagccatattggatctattagacgaattgccaacagttttagaaactccgccatctgatttagaaggggtaaatattgaagaatataacaatctattttgggttattcctcttcctacgatcagtcaaaactatatcagtaacactgaattcgcgagattgcgagttgctgggtttaatcccttagtgattcaacgagttaaagcattagatgcaaggttccctttaacagaggagcaattccagacagttttgccaaatgattctttagccttagcaggagccgagggtcgtttgtatttagccgattatgcagaactagaggcgatcgctggtggtacatttcccacaggagagcaaaaatatgtcaatgctcctttagctctgtttgccattccacaaggagaaagaagtctgactccgatcgcaattcaactggggcaagacccgaatatcaatcccatctttttgcgccgagttggtgacgaaccgaactggttgattgctaaaactgttgttcaaattgctgatgctaatcaccatcaactgattagccatttgggtagaacccatttatttgtcgaaccatttgtaattgccaccaatcgccaacttgccagcaatcatcctctgtatattttactgaaaccccatttccaagggactttagcgatcaatgacgcagcgcagtcaaacctagttagcgttggtggtggtgttgatagtttgctagcagggacgattgcaagttctcgcgctgtttctgtacatggggttaagtcttatcaatttgaagatgcgctccttcctaatgcactcaagaaacgcggcgttgatgatcccagcttattgccagactatccctatcgcgacgatgcgttattaatttgggaagcgatcgctacttgggtgaagagttatctatcgatttattatttcaatgatgatgctgtggttcgcgatacggaactgcaagcatgggcaaaggaaatcattgctaatgatggtggtcgggtgactagctttggtgaaaatggacagattcggactttatcctatttagctgatgccctgactgcggtgatcttcacaggtagcgctcaacatgcggcagtgaatttcccgcagggagatctgattgtttatacgcctgcgattcctttggcgggttatacacctgcgccaactcagactacaggtgcagaagaagcagatttctttgcgatgttgccgccgatcgaacaagctaagggacaattgaaactaacttatattctcggttcggtctattacacgacactgggagattatggtactgattatttcagcgacgatcgcattcagcagcctttacgcgattttcaagatctgttaaaggagatcgaatctacgatcaagtctcgcaatgaacaacgagttgcagattataactatttgagaccatcacggattccccaaagcattaatatctaa

SEQ ID NO: 174 - protein, 624 aa, Pseudanabaena sp. SR411
MIFSLLSGVARILNFVAAKLVDLADWISRRSPSSKYPLLPQNDPEINQRQAFLNNARQLYQYNYTYIDSLPMVETVPTIERFSLSWGLLVGKAVVTVLLNERANLSLEKDKLASQAKQREFSKRLLEAGMSHSDTAILDLLDELPTVLETPPSDLEGVNIEEYNNLFWVIPLPTISQNYISNTEFARLRVAGFNPLVIQRVKALDARFPLTEEQFQTVLPNDSLALAGAEGRLYLADYAELEAIAGGTFPTGEQKYVNAPLALFAIPQGERSLTPIAIQLGQDPNINPIFLRRVGDEPNWLIAKTVVQIADANHHQLISHLGRTHLFVEPFVIATNRQLASNHPLYILLKPHFQGTLAINDAAQSNLVSVGGGVDSLLAGTIASSRAVSVHGVKSYQFEDALLPNALKKRGVDDPSLLPDYPYRDDALLIWEAIATWVKSYLSIYYFNDDAVVRDTELQAWAKEIIANDGGRVTSFGENGQIRTLSYLADALTAVIFTGSAQHAAVNFPQGDLIVYTPAIPLAGYTPAPTQTTGAEEADFFAMLPPIEQAKGQLKLTYILGSVYYTTLGDYGTDYFSDDRIQQPLRDFQDLLKEIESTIKSRNEQRVADYNYLRPSRIPQSINI

SEQ ID NO: 175 - DNA, 1878 bp, Pseudanabaena frigida
  CDS (1)..(1878)
atggtcttctcgcttttgagtggtgttgccaaaacattaaatttcgtcgcatctaagttgaaagacttggctgattggatatcaaggcgatcgccttctagcaaatatccgctactgccccagaacgatcctgaaataaagcagcgtcaatcgtttctagataatgcaaggcaactctatcaatataactacacctacattgactcgctcccactggtggaaacagttcccaccaatgagagattttctttgtcttggggattgctagttggcaaggcagcaatcaaggttttgctgaatgagcgggcgaatccattgttgttggaagcggggaaacaaacctctaaggctaagcaacaagacttctcaaaacgtttgctggaagctagtgtagctcagtcagaatctgccctattggaactattggaagatttgccaacggttttagaaactccacccagtgaattagaaggggtgaatattgaagagtataacaatttgttttgggttattcctcttccctcgatcagtcaaaactataccagtaataaagaattcgccagattgcgagttgctgggtttaatcccttagtgattcaacgaattacagccctagatgcaagatttcctttaactgaagcgcaattccagaaggttctacccaatgattctttggctgtagcaggagccgaaggtcgtttgtatttagccgattatgcggaactagaggcgatcgttggtggcacatttcccacgggagagcagaaatatatcaatgctcctttagcgctgtttgccattcctcaaggggaaaagagcctgactccgatcgccattcaactaggacaagaccccaatacccatcccatctttttgcaccaagtcggtgacgaaccaaactggttaattgctaaaactgttgttcaaattgccgatgccaatcaccatcaactgattagtcatttgggtagaactcatttatttgtcgaaccctttgtaattgctactaatcgccaacttgcaagcaatcatcctttgtatatcttgctgaagccacattttcaagggactttggcaattaatgacgcagcacagtccaaactggttagcgctggtggcggtgttgatagtttgctagcaggtacgattgagagtgctcgcgctgtttccgtacatggggtcaaaacctataaatttgaagatgcgctgctacctaaagccctgaaaaaacgtggcgttgacgatcccaacttattgccagattatccctatcgtgatgatgctttattagtttgggaagcgatcgctacttgggtgaaaaattatctatcaatctattacttcaatgatgaagatgtgattagagatacggaactgcaagcatgggcaaaggaaatcatcgctaatgatggtggtcgggcgactagcttcggtgaaaatgggcagattcggactttatcctatttagctgatgctttgactgcggtgatctttacaggtagcgctcaacatgcggcggtaaacttcccacagggtgatttgattgtttatacgcctgcgattcccttggcgggttatacgcctgcaccaactcagactacaggtgcaaccgaagccgatttcttttcactccttccgccaattgagcaagctaagggacaattgaaactaacctatattctcggctcagtctattacacaacgctgggagaatatggtgatggttatttcactgacgatcgcattgagaagccattacgggattttcaagataatttgaaagcgatcgagtcagaaatcaagtctcgcaacgaaaaacgagttgcagattacaattatttgaaaccatcacggattcctcaaagtatcaatatctaa

SEQ ID NO: 176 - protein, 625 aa, Pseudanabaena frigida
MVFSLLSGVAKTLNFVASKLKDLADWISRRSPSSKYPLLPQNDPEIKQRQSFLDNARQLYQYNYTYIDSLPLVETVPTNERFSLSWGLLVGKAAIKVLLNERANPLLLEAGKQTSKAKQQDFSKRLLEASVAQSESALLELLEDLPTVLETPPSELEGVNIEEYNNLFWVIPLPSISQNYTSNKEFARLRVAGFNPLVIQRITALDARFPLTEAQFQKVLPNDSLAVAGAEGRLYLADYAELEAIVGGTFPTGEQKYINAPLALFAIPQGEKSLTPIAIQLGQDPNTHPIFLHQVGDEPNWLIAKTVVQIADANHHQLISHLGRTHLFVEPFVIATNRQLASNHPLYILLKPHFQGTLAINDAAQSKLVSAGGGVDSLLAGTIESARAVSVHGVKTYKFEDALLPKALKKRGVDDPNLLPDYPYRDDALLVWEAIATWVKNYLSIYYFNDEDVIRDTELQAWAKEIIANDGGRATSFGENGQIRTLSYLADALTAVIFTGSAQHAAVNFPQGDLIVYTPAIPLAGYTPAPTQTTGATEADFFSLLPPIEQAKGQLKLTYILGSVYYTTLGEYGDGYFTDDRIEKPLRDFQDNLKAIESEIKSRNEKRVADYNYLKPSRIPQSINI

SEQ ID NO: 177 - DNA, 1911 bp, Ahniella affigens
  CDS (1)..(1911)
atgagtcttttttcacgcgttcgtccgacccttccgcagaacgactcccccgcagcgcagcagcagcgccaagaggcattgctggacgaacagagcaagtatgtctggaaagatgatttcgagacgcttccgggaatccctttggcggcaagcgtgccgcgcgacgatcggccaaccatcacctggctcttagaagtggcggacgtcggcatcgacattgtggccaaccaaatcctggcccaaacgggccgcggtgactcactcaaatcgcagactgcggccgctgcgatcagaccacatttggatagcatgcgtcagaccatagcgacgattcgcagcgagcagaaggcgaccccggacagcccgcttcgaatcgtcgaccatgtggccgggacgctgctcagtctgcatcgctcccgcctggacaacgagttgaaaacgctgcagaacatgattgcggcaacctacctcggcaagctggaaaacccgagcctggagcagtatcgaaagctgtttgtcacgctgcccttgccggcaatcgccgataccttcatggacgacgcgacatttgcccggatgcgcgtcgccgggccgaacagcgtgctgattgccggcctgagtgcctggccgttgaagtttgggctcagcgaggcgcagtatcaatcggtgatgggcaccaacgatagtctggcctcggcgttaaccgagcagcggctctactggctcgattacgaggaactgagcactctgaaaacgggcaccactggtggaaagcccaagttcttatgtgccccgctcgcgctgtttgcgatcccgaagggcggtggcgcgctgacgccggttgccattcagctcggacaatcaccggcagacggcttgttcctccgggtcagcgaccagaacagtcctgactggtggtcgtggcagatggccaagacgttcgtacaggccgccgagggcaactatcatgagctgtttgtgcatctcgcccgcacgcacctcgtcatcgaggcatttgccgtcgcgacgcatcggcggctggcgcccgagcacccgctgaacgtgctgttgctgccgcattttgaaggcaccctgttcatcaacaattctgcggcaggcagtttgattgctgaaggtggtccgatcgaccatatttttgctggacagatcacctccacccagaccctcgccggtagcgaccggctggcgtttgatgtcaccgcacacatgctgcccaacgacttggccagccgtcgtgttgccgacgtcgccgcactccctgactacccgtatcgcgatgacgcactgctggtctggcaggcgattcaagactgggtccggcaatacgtcagcgtctactatctgaacgatgccaacgtcgcgggcgacaccgaactgcaaggttggcgtgacgagttgctcgggctcggcaaaatcaaggggctgccggaactcaaggaccgtgagacgctgatcagcgtggtgacgatggttatctttacggccagtgctcagcacgccgcggtgaacttcccgcagaaggacttgatgagctttgcacccgcaatcagcggagccgcgtgggcgccggtgcctaagcccgatcagccgcaatcggaggcggcctggctgaaactgttgccgccgatcaaggaagcacaagagcagttgaacgtgctgtggttactcggatcggtgcactatcggccgctcggtgactaccgggtgaaccattggccgtatctgccctggtttcaagatccgcgcatcacgggcaagaatggcccgctggcacgtttcaaactggcattgaaggcggtggagatggaaatcgataaccggaacgccgagcgcgaggtgccgtatccttatctgcagccgagtttgattccgaccagcatcaacatctga

SEQ ID NO: 178 - protein, 636 aa, Ahniella affigens
MSLFSRVRPTLPQNDSPAAQQQRQEALLDEQSKYVWKDDFETLPGIPLAASVPRDDRPTITWLLEVADVGIDIVANQILAQTGRGDSLKSQTAAAAIRPHLDSMRQTIATIRSEQKATPDSPLRIVDHVAGTLLSLHRSRLDNELKTLQNMIAATYLGKLENPSLEQYRKLFVTLPLPAIADTFMDDATFARMRVAGPNSVLIAGLSAWPLKFGLSEAQYQSVMGTNDSLASALTEQRLYWLDYEELSTLKTGTTGGKPKFLCAPLALFAIPKGGGALTPVAIQLGQSPADGLFLRVSDQNSPDWWSWQMAKTFVQAAEGNYHELFVHLARTHLVIEAFAVATHRRLAPEHPLNVLLLPHFEGTLFINNSAAGSLIAEGGPIDHIFAGQITSTQTLAGSDRLAFDVTAHMLPNDLASRRVADVAALPDYPYRDDALLVWQAIQDWVRQYVSVYYLNDANVAGDTELQGWRDELLGLGKIKGLPELKDRETLISVVTMVIFTASAQHAAVNFPQKDLMSFAPAISGAAWAPVPKPDQPQSEAAWLKLLPPIKEAQEQLNVLWLLGSVHYRPLGDYRVNHWPYLPWFQDPRITGKNGPLARFKLALKAVEMEIDNRNAEREVPYPYLQPSLIPTSINI

SEQ ID NO: 179 - DNA, 1875 bp, Pseudanabaena sp. ABRG5-3
  CDS (1)..(1875)
atgatcttctcaattttgagcggtgtcgccagaatattaaatttcctctcggataagctagccaatttagctaatttaatatctaagccatcgaagtcgagcaactatccactactgccccagaatgatcccgaaatttctcagcgtcaggcgttgctaaataagtctcggcaactgtatcaatacaactacacctatattgattcgctgccgatggtggagaaagtgccaaccagcgagagattttctctatcttggggattgttggttgggaaggttgtggtcaaggtattgctcaatgatcgcgctaatcctgccgcatttattgataaggaaaaatcgaaagccaagcaactggaattctcgaagaagttgcttgaggcgagtatggcgaagtcggatacggctttggtggaattactttccaacttacctgcaattcttgaagatgatcccattgatgtagcaggctcgaatattcaagaatacaacgagcttttttggattattccccttccgacaattagtcaaagcttgtttagtaatactgaatttgcaaggttgcgggttgcgggttttaatcctttgatgattcaacgggtaacttctctggatgcaagattccctgtaactgaagcccagtttcaatcagttttggcagatgattctctcgccgccgcaggtgctgaaggacgcttgtatttagcggattatgccgaattagaagcgctgactggggggacatttccgaagggtaagcagaaatatattaatgcgcctttagctctctttgcggttcctaaagggaaaaagagtctgactccgatcgcgattcagttagggcaagaccctaatacgcatccaatttttgttagtcaacatggggatgagccgaattggttgattgcgaaaaccgttgtccagattgctgatgctaattaccatcaactgattagccatttaggacgtacccatttattcattgaaccctttgcgatcgctacaaatcgtcagttggctaacaatcaccctctgtatattttgctgaagccccatttccaaggtactttggcgattaatgatgctgctcagtcgggactggtgagtgcaggtggaactgttgatagcttattagcaggaactattgatactgctcgcgccctatcggtgcatggagtcaaaacctataattttgatgaagcaatgctacctgttgcgctcaaaaaacgtggcgttgacgatccaaagttactgcctgaatatccctatcgcgatgatgcgttattggtgtgggaagcgatcgctacttgggtaaagaactatctctctgtttactatgaaaatgataatgatgttgctagggattcagaactacaagcatgggttaaggaaattactgctaacgatggcggtcgggtaacgagctttgggcaaaatggacagattcgcaccctatcctatttggttgatgctgtgaccctgctcatctttaccagtagcgcccagcacgcggccgtgaactttccccaaggtgacttgatggactatgcccctgcggttcctttagctggctatactcctgcgcccactagtaccactggtgcaaccatagataatttctggtcgatgattcctgctattgatcaggcaaaaagtcagttaacgatgacctatattctcggctcggtctattacacgactttgggagattatggcaatgcgtatttcactgacgatcgcattgagcagcccctgcgcgatttccaagacaatttgaaggcgattgagtctacgattaagtctcgcaatgagcagcgaaatgtggattatagttatctcagaccatcacgcattcctcaaagtattaatatctaa

SEQ ID NO: 180 - protein, 624 aa, Pseudanabaena sp. ABRG5-3
MIFSILSGVARILNFLSDKLANLANLISKPSKSSNYPLLPQNDPEISQRQALLNKSRQLYQYNYTYIDSLPMVEKVPTSERFSLSWGLLVGKVVVKVLLNDRANPAAFIDKEKSKAKQLEFSKKLLEASMAKSDTALVELLSNLPAILEDDPIDVAGSNIQEYNELFWIIPLPTISQSLFSNTEFARLRVAGFNPLMIQRVTSLDARFPVTEAQFQSVLADDSLAAAGAEGRLYLADYAELEALTGGTFPKGKQKYINAPLALFAVPKGKKSLTPIAIQLGQDPNTHPIFVSQHGDEPNWLIAKTVVQIADANYHQLISHLGRTHLFIEPFAIATNRQLANNHPLYILLKPHFQGTLAINDAAQSGLVSAGGTVDSLLAGTIDTARALSVHGVKTYNFDEAMLPVALKKRGVDDPKLLPEYPYRDDALLVWEAIATWVKNYLSVYYENDNDVARDSELQAWVKEITANDGGRVTSFGQNGQIRTLSYLVDAVTLLIFTSSAQHAAVNFPQGDLMDYAPAVPLAGYTPAPTSTTGATIDNFWSMIPAIDQAKSQLTMTYILGSVYYTTLGDYGNAYFTDDRIEQPLRDFQDNLKAIESTIKSRNEQRNVDYSYLRPSRIPQSINI

SEQ ID NO: 181 - DNA, 1881 bp, Pseudanabaena sp. Roaring Creek
  CDS (1)..(1881)
atgatctcttcgattttgcgtggtattgcccaaatattaaatttccttgcgactaagttgtccgacttagcaaatttaatattgcggcgatcgccttcaagtaaatatcccctattacctcagaacgatcccgaaatcgatcgacgacaggctctgctcaaccagtctagacagctctatcaatataactacacctatgtcgcccccttgccgatggtcgaaaaagtgccaactggcgagcagttctcattgtcttggggcttattggtaggaaaggcagttatcgaaattttattaaatgatattgcgaatcctttcctcttgagtgaaaagggtaaaaatgcctctaaagctaggcaacaagacttctcaaaacgtttacttgaagctggcgttgctcagtcgaattccgcaataataggtctgctgtcagagattcccaccctattagagaccgaacccaccaacgtcgaaggttcaaacattaaggaatataacgatcttttttggattatttctttgcccaagatcagtcaaaattttacaactaattccgagtttgcaaggctccgcgtcgctggatttaaccctgtgacgatccaacgcatcaagaccttagatgcgaaatttcctctcacggaagatcaatttcaaacggtgttagcgggggactctctcgctgaggctggagcacaaggtcgcttgtatctggctgattatgcagagctaacggcgatcgcgggtggtacttttcctaagggagcgcaaaagtatataaatgcacctttggcattgtttgccgttcccaaaggacagcagagtttgacaccgatcgccattcaattagggcaagaccccagtgcttatcccatctttgtctgtcaggctgatgatgaaccgaactggcttctagctaaaaccgttgtccagattgctgatgccaattaccacgaactgattagccatttaggtagaacccatttatttatcgaaccctttgcgatcgcgactaatcgccaacttgccagcaatcatcctttgtacattctgctcaagcctcatttccaaggaactttagcgatcaatgatgccgctcaatcgggactgattagtgctggtggaaccgtggatagtctactagcgggaacgatcgcttcctcgcgcaccctgtcggcacagtccgttgaaaactataacttcaatgaagcgatgttgcctgtagccctgaaaaagaggggagtggacgatgtcaatatgctgcccgattatccctatcgcgatgatgctttattggtctggggagcgatcgcaacttgggtcaaaaactatctatccatctattatttcagcgataccgatgtcatgagagatgtggaactgcaagcatgggcaaaggaaattacctcgattgatggcgggcgcgtcaagagttttggtcaaaatggtcagattcagacctttgattatttggtcgatgcggtgacattgctgatctttaccagcagcgcccaacatgcggcagtaaacttccctcaaggcgatttgatggactacacgccagcaattccgctagcaggctatactcccgcaccaacggcaaccactggtgcaacggaagcagatttctttgccatgctaccgcccatcgaccaagctaagagtcaattgaccatgacctatattttgggctctgtttattacacgaccctaggcgactatggttcagattatttcaacgacgatcgccttcagcaacccttacgcgattttcaagatgggttaaaagcgatcgagtctacaattaagtcgcgcaatgagactagggctgctgattacaattacttaaaaccatcacggattcctcaaagcattaatatctaa

SEQ ID NO: 182 - protein, 626 aa, Pseudanabaena sp. Roaring Creek
MISSILRGIAQILNFLATKLSDLANLILRRSPSSKYPLLPQNDPEIDRRQALLNQSRQLYQYNYTYVAPLPMVEKVPTGEQFSLSWGLLVGKAVIEILLNDIANPFLLSEKGKNASKARQQDFSKRLLEAGVAQSNSAIIGLLSEIPTLLETEPTNVEGSNIKEYNDLFWIISLPKISQNFTTNSEFARLRVAGFNPVTIQRIKTLDAKFPLTEDQFQTVLAGDSLAEAGAQGRLYLADYAELTAIAGGTFPKGAQKYINAPLALFAVPKGQQSLTPIAIQLGQDPSAYPIFVCQADDEPNWLLAKTVVQIADANYHELISHLGRTHLFIEPFAIATNRQLASNHPLYILLKPHFQGTLAINDAAQSGLISAGGTVDSLLAGTIASSRTLSAQSVENYNFNEAMLPVALKKRGVDDVNMLPDYPYRDDALLVWGAIATWVKNYLSIYYFSDTDVMRDVELQAWAKEITSIDGGRVKSFGQNGQIQTFDYLVDAVTLLIFTSSAQHAAVNFPQGDLMDYTPAIPLAGYTPAPTATTGATEADFFAMLPPIDQAKSQLTMTYILGSVYYTTLGDYGSDYFNDDRLQQPLRDFQDGLKAIESTIKSRNETRAADYNYLKPSRIPQSINI

SEQ ID NO: 183 - DNA, 1881 bp, Pseudanabaena biceps
  CDS (1)..(1881)
atgatctcttcgattttgcgtggtattgcccaaatattaaatttccttgcgactaagttgtccgacttagcaagtttaatattgcggcgatcgccttcaagtaaatatcccctattacctcagaacgatcccgaaatcgatcaacgacaggctctgctcaaccagtctagacagctctatcaatataactacacttacgtcgcccccttgccgatggtcgaaaaagtgccaactagcgagcagttctcattatcttggggcttattggtaggaaaggcagcgatcgaagttttattaaatgatattgcgaatcctttcctcttgagtgaaaagggtaaaaatgcctctaaagctagggagcaagacttctcaaaacgtttacttgaagctggcattgctcagtcgaattccgcaataatagggctactgtcagagattccctccctattagagaccgaaccaaccaatgttgaaggttcaaatattaaggaatataacgatcttttttggattatttctttacccacgatcagtcaaagttttacaactaattccgagtttgcaaggcttcgcgtcgctggatttaaccctgtgacgatccaacgtatcaagaccttagatgcgaaatttcctctcacggaagatcaatttcaaacagtgttagcgggggactctctcgctgaggctggagcgcaaggtcgcttgtatctggctgattatgtagatctaacggcgatcgcgggcggtacgtttcctaaaggagcacaaaagtatataaatgcacctttggctctgttcgcagttcccaaaggacagcagagtttgaccccgatcgccattcagctagggcaagaccccagtgcttatcccatctttgtctgtcaggctgatgatgaaccgaactggcttctagctaaaaccgttgttcagattgctgatgccaattaccacgaactgattagccatttaggtagaacccatttatttatcgaaccctttgcgatcgcaactaatcgccaacttgccagcaatcatcctttgtatattctgctcaagcctcactttcaaggaactttagcgatcaataatgccgctcaatcgggactgattagtgctggtggaaccgtagatagtctattagcgggaacgatcgcgtcctcgcgcaccctttcggtacagtcagttaagaactataacttcaatgaagcgatgttgcctgtagccctgaagaagagaggggttgacgatgttaatatgctgcccgattatccctatcgcgatgatgctttattggtctggggagcgatcgcgacttgggtcaaaaattatctatccatctattatttcagcgataccgatgtccttagagattctgaactgcaagcatgggcaaaggaaattacctcggttgatggtgggcgcgtcacaagttttggtcaagatggtcagattcagaccttcgattatttagtcgatgcagtgacattgctgatctttaccagcagcgctcaacatgcggcggtaaacttccctcagggagatttgatggactacacgccagcaattccgctagcgggctatactcccgcaccaaagtcaaccactggtgcaacggaagcagatttctttgccatgctaccgcccatcgaccaagctaagagtcaattgacaatgacctatattctgggatctgtttattacacgaccctaggcgactatggttcagattatttcaacgacgatcgccttcagcaacccttacgcgattttcaagatgggttaaaagcgatcgagtctacaattaagtcgcgcaatgagactagggttgctgattacaattacttaaaaccatcgcggattcctcaaagcattaatatctaa

SEQ ID NO: 184 - protein, 626 aa, Pseudanabaena biceps
MISSILRGIAQILNFLATKLSDLASLILRRSPSSKYPLLPQNDPEIDQRQALLNQSRQLYQYNYTYVAPLPMVEKVPTSEQFSLSWGLLVGKAAIEVLLNDIANPFLLSEKGKNASKAREQDFSKRLLEAGIAQSNSAIIGLLSEIPSLLETEPTNVEGSNIKEYNDLFWIISLPTISQSFTTNSEFARLRVAGFNPVTIQRIKTLDAKFPLTEDQFQTVLAGDSLAEAGAQGRLYLADYVDLTAIAGGTFPKGAQKYINAPLALFAVPKGQQSLTPIAIQLGQDPSAYPIFVCQADDEPNWLLAKTVVQIADANYHELISHLGRTHLFIEPFAIATNRQLASNHPLYILLKPHFQGTLAINNAAQSGLISAGGTVDSLLAGTIASSRTLSVQSVKNYNFNEAMLPVALKKRGVDDVNMLPDYPYRDDALLVWGAIATWVKNYLSIYYFSDTDVLRDSELQAWAKEITSVDGGRVTSFGQDGQIQTFDYLVDAVTLLIFTSSAQHAAVNFPQGDLMDYTPAIPLAGYTPAPKSTTGATEADFFAMLPPIDQAKSQLTMTYILGSVYYTTLGDYGSDYFNDDRLQQPLRDFQDGLKAIESTIKSRNETRVADYNYLKPSRIPQSINI

SEQ ID NO: 185 - DNA, 1884 bp, Leptolyngbya sp. PCC 7376
  CDS (1)..(1884)
atgaccgcgacctccccatctagtagccaaaacctcagcgacaaacaggaaaaataccaatacaactatcggtatatgcccccattggcgatggtcgacagcctgcctgaagaagagcaatggtctacctcttggaaaatgacggtgggtaaagttggcttccagctccttgtcaacaaaatcattttgaattatggcgatcaaggagaagcaggggcagcagacgacgttcgcgcttttttgattagtacctttaaacaaaccctcgccgaacaaaaaggcttttcaaaagtggggattctcctgcaaggcgccaaatttttacccagattaatttggggcaagatcaccacacaaatcgtcgatgtcgaagatttgatgaaagagatgatcgaaagcatgagtcgcaaatttttagaggactttgcggccaatgttatgcaaaagttgaccgaagatgcccccaaaggtcgcttttcatcaatcaaagaatttgaaacgctattcacagaaatcgatctgcccgatattgcctacacctatcaggaagacgaaaccttcgcctatatgcgcgttgctggaccgaatgctgtaatgctccagaaaatcaccgagccagatccccgtttcccagtcacagaagcccattaccaagcggttatgggagaagaagattctttagccgcagcacgctcagaaggtcgtttatatttgtgcgactatgccatcctcgatggggcaatagagggagattttcctgtggctcagaaatatctctatgcaccattagcactcttcgctgtgcccaaagctgatgcagtcaaacgaaatttaatgcctgtagccattcagttaggtcaagtccctaaacaaaaccctattctgactcccaaatctaataaatatgcatggctctgtgcgaaaacggcagtgcagattgctgatgccaatttccatgaagcggtcacccatctagctcgcacccacttgtttatggggccctttgcgatcgccacccatcgacaactaccagagagccatcccctctttaaactacttaaacctcatttttttgggatgctggccattaacgactcagcccaagctaaactcattgcgaaaggcggtggcgtcaataaaatcctctctgccactatcgataacgcccgtttattcgccatcttgggcgtacaaacctatggctttaacagtgccatgctacgcaaacaattggcagccagaggcgttgatgatactgagggattacctatttatccgtatcgtgacgatgctctattaatttgggatgccattaataattgggtgcaaagttatctcaaaacctactatgcgaatgatgcagcagtgcggagagatcaggcgatccaagcttgggtaaaagaattaatctccgaagatggcggtcgtgtggtggaatttggggaagatggtggcatccaaactcttgagtatcttatcgaagcagtgacactcatcatttttacggtgagcgcgcaacatgcagcagtaaatttccctcaaaaaaatcttatgagcttcgcccctggtatgcccacagcaggttactcaccccttgataatctcggggaacacaccacagagcaagactatctcgatttattaccaccgatgtcccaagctcaggaacagctcaaactctgtcacttattaggttctgcacattttactgagcttggtcaatatgatgccaagcatttcaccgacttcaagattcaaggggcactcaaacaattccaagcacgcctaaaagagattgaaggtattattcacaaacgcaatcgtgatcgccctgaatacgaataccttttaccatcgctaattccccaaagtatcaatatctag

SEQ ID NO: 186 - protein, 627 aa, Leptolyngbya sp. PCC 7376
MTATSPSSSQNLSDKQEKYQYNYRYMPPLAMVDSLPEEEQWSTSWKMTVGKVGFQLLVNKIILNYGDQGEAGAADDVRAFLISTFKQTLAEQKGFSKVGILLQGAKFLPRLIWGKITTQIVDVEDLMKEMIESMSRKFLEDFAANVMQKLTEDAPKGRFSSIKEFETLFTEIDLPDIAYTYQEDETFAYMRVAGPNAVMLQKITEPDPRFPVTEAHYQAVMGEEDSLAAARSEGRLYLCDYAILDGAIEGDFPVAQKYLYAPLALFAVPKADAVKRNLMPVAIQLGQVPKQNPILTPKSNKYAWLCAKTAVQIADANFHEAVTHLARTHLFMGPFAIATHRQLPESHPLFKLLKPHFFGMLAINDSAQAKLIAKGGGVNKILSATIDNARLFAILGVQTYGFNSAMLRKQLAARGVDDTEGLPIYPYRDDALLIWDAINNWVQSYLKTYYANDAAVRRDQAIQAWVKELISEDGGRVVEFGEDGGIQTLEYLIEAVTLIIFTVSAQHAAVNFPQKNLMSFAPGMPTAGYSPLDNLGEHTTEQDYLDLLPPMSQAQEQLKLCHLLGSAHFTELGQYDAKHFTDFKIQGALKQFQARLKEIEGIIHKRNRDRPEYEYLLPSLIPQSINI

SEQ ID NO: 187 - DNA, 1890 bp, Nodularia spumigena
  CDS (1)..(1890)
atgactacttcatcaccagataattcccgcagtctccccatcacccagaatttggaattagcgaggcaggaatatcaatataactatacccatattccacctattcctatggtgaatcagcttcctaatcaggaaaacttcactactagatggacttttttattagcccagcagttacgggagattttcattaatactctgatcactaaccgaggcgatcgcagttccaaatcggttcgtgatcaagtcaaaaggtttattttagaagccttgttcaagggggctataccagccaaagtaagtgtgattgcgagacttttccaaattattccccagtttctcattcaaggaatatctaaagattttcacgaactagatgatctgtttttttcccttttcaaaaccaacggactgttaatattcagagattctctgaatcgaattacagcccttttagataaaggccatcccacaggtcatgtgaatagtttaaaggactaccaaaagttatttaccacaattgaattaccagcgatcgccaaaactttcgatcaagatcaagtctttgcctatatgcaagtcgccggctacaatcccctagtcatcaagcgggtaaatagtccaggcgctaacttcccagttgaagagacacattaccaagcagtcatggggagcgatgattcattagcagccgcaggacaagaaggaaggctatacctagcagactatcaaattttagacggtgctatcaacggtacatatctaaattaccaaaagtatgcctatgctcccctagcgctgtttgccatccccaaaaactcagaccccaatcgtctcctgcgccccatagctattcaatgtggtcaaactcctggagccgattatcccataattacccccaattccggcaaatacgcctggctatttgccaaaaccattgtccacatagccgatggcaactttcatgaagccgtcagtcacctcgcccgaacgcacctattcgttggtgtctttgtcatcgccacccatcggcaattgtcccccagccatcccctcagcctcctactgcgtccccattttgaaggcactttagcaattaacaatgccgcccaagaagttttgattgctcctggcggcggagttgataggttactctcatcgaccattgataactcacggattttagcagtgcgcggtttgcaaagctatagtttcaatgaagctatgttgccaaaccaactcaaacaaagaggtgttgatgatcctgaactactgcctgtttatccttaccgggacgatgcactactaatttggaacgccattcatcaatgggtttccgactacctgagcctttattaccctacagataaagatattcaaaatgatactgctttgcaagcatgggcagccgaagccaaagctgagaatggtggacgtgtacctgattttggtgaaaatggaggtattcagacactagactacctagttgatgctgctaccctgattatttttacagccagcgcccaacacgcggcggttaacttcccccaaaaagatttgatgagttatgccccagcttttcccttagcaggatatgtatccgcctccatcaagggagaagttagtgaacaagactacctgaatttactcccacctttggagcaagcgcaacagcaatttaacttgctcactttactagggtctatatattacaaccagcttggtgaatatccaaaatcacactttgctaaccccaaggtacaaaccttgttacagaagttccaaagccaactccagcaaattgaaattacgatcaatcagcgcaatttgcaccgcccaacttacgaatatctacttccttctaaaatccctcagagcattaatatttga

SEQ ID NO: 188 - protein, 629 aa, Nodularia spumigena
MTTSSPDNSRSLPITQNLELARQEYQYNYTHIPPIPMVNQLPNQENFTTRWTFLLAQQLREIFINTLITNRGDRSSKSVRDQVKRFILEALFKGAIPAKVSVIARLFQIIPQFLIQGISKDFHELDDLFFSLFKTNGLLIFRDSLNRITALLDKGHPTGHVNSLKDYQKLFTTIELPAIAKTFDQDQVFAYMQVAGYNPLVIKRVNSPGANFPVEETHYQAVMGSDDSLAAAGQEGRLYLADYQILDGAINGTYLNYQKYAYAPLALFAIPKNSDPNRLLRPIAIQCGQTPGADYPIITPNSGKYAWLFAKTIVHIADGNFHEAVSHLARTHLFVGVFVIATHRQLSPSHPLSLLLRPHFEGTLAINNAAQEVLIAPGGGVDRLLSSTIDNSRILAVRGLQSYSFNEAMLPNQLKQRGVDDPELLPVYPYRDDALLIWNAIHQWVSDYLSLYYPTDKDIQNDTALQAWAAEAKAENGGRVPDFGENGGIQTLDYLVDAATLIIFTASAQHAAVNFPQKDLMSYAPAFPLAGYVSASIKGEVSEQDYLNLLPPLEQAQQQFNLLTLLGSIYYNQLGEYPKSHFANPKVQTLLQKFQSQLQQIEITINQRNLHRPTYEYLLPSKIPQSINI

SEQ ID NO: 189 - DNA, 1917 bp, Calothrix sp.
  CDS (1)..(1917)
atgagatcaccaactccaaaacaacgacgacaagagttaattgagcagtatgtattatcgcgccgtaccatgatggcgctgatggccttcgcttgtactcctggtttggaaactttactagtcggtgacaataaatcctcaaaacctaagcaattggataatccgaatggttgtactcccggtttggaaactttactatctaatgacaataaaccctcaaaacctaagccaccaaataatcctagcatcccaagcttacctcaaaatgatacaaaagcgactcaacaagaacgcctgacgcagttgggaaagactcgtgaagaatatcagttggggttgcggttgcctaattctgctcgcgtgaagactttacccgcgactgaattattttctgaaggatacgagaagaaccgagtaatcttatcgcagaagataggagccaatcaacaagcgtttttacaaaaccccaaaccttttcaaagcttcgatgattacagcgcgctgtttcccgttttgccgctacccgatatcgctaaaacattccgtaatgattcggtattcgcacgacagaggctttctggctgtaacccgatggaactaaagaacgttctagcacttgattataatcttcgtagcaaactcgccataacagatgaaatttttcaagctgtgctaaatgcgacaagaaccagagagcgcattaataagactctcaacagcgctattcgagaaggcagcttatttgttaccgattatgcaatacttgatagcattcagccgaaagaaaagcaatttgtttgtgcccccattgcactctattatgcccaaagaattcgtggcgattttcagctaatccccattgctatccagttaggacaggcgccgggttcaagtttactttgcacaccaaatgatggagtagattggactttagccaagttaataacccaaatggctgatttctacgtcaatcagttatatcggcacttgggacagactcatctagtaatggagccaattgctttagcaacagcgcgcgaactagctgcgaagcatcccgtaaacgtactcttaaagcctcactttgagtttacaatggcaattaatagccttggtgatgaagtgctaattaatccgggcggagcagtagatattatattaccgggtactttagaaagctcgctaaaacttaccgatacaggtgtagctgactttttcaacaactttagcagctttgcacttcctactaatttacgtcagcgcggtgttgataatccttataccttaccagattttccttatcgagacgacgggttgctcgtttggaatgctttagaagactatgtaagtaaatatatcggtatttactataaatctaaccgagatatccgcgaggatttcgagctacaaaattggttccaagttttacggaaaccaaagagcgaaggtggttttggtatagtttcattaccagcaaacctgacaaaccgcgaccaattgatagacattttgacaataattattttcactgctggtccccaacactcagccattgcttggactcaatatcaatatatggcttttattcctaatatgcctggagctatttatcagcctattcctacaactaaagggaaattcgctgacgaaaacagccttactagtttcctacctggaatcaaaccaagccttacccaagttcagtttatgtcgttagtcggtaccaagcgcgacccaaaagcatttactgattttggtgtgaacagttttcaagacccgcaagccattagagttcttagagatttccaaaatcgtttagaatcaatagaaaaacggattgaagcacaaaatcaacgtcgcgaagaatgctacccggcgtttcttccctctcggatgtctaatagcgtaagtggttga

SEQ ID NO: 190 - protein, 638 aa, Calothrix sp.
MRSPTPKQRRQELIEQYVLSRRTMMALMAFACTPGLETLLVGDNKSSKPKQLDNPNGCTPGLETLLSNDNKPSKPKPPNNPSIPSLPQNDTKATQQERLTQLGKTREEYQLGLRLPNSARVKTLPATELFSEGYEKNRVILSQKIGANQQAFLQNPKPFQSFDDYSALFPVLPLPDIAKTFRNDSVFARQRLSGCNPMELKNVLALDYNLRSKLAITDEIFQAVLNATRTRERINKTLNSAIREGSLFVTDYAILDSIQPKEKQFVCAPIALYYAQRIRGDFQLIPIAIQLGQAPGSSLLCTPNDGVDWTLAKLITQMADFYVNQLYRHLGQTHLVMEPIALATARELAAKHPVNVLLKPHFEFTMAINSLGDEVLINPGGAVDIILPGTLESSLKLTDTGVADFFNNFSSFALPTNLRQRGVDNPYTLPDFPYRDDGLLVWNALEDYVSKYIGIYYKSNRDIREDFELQNWFQVLRKPKSEGGFGIVSLPANLTNRDQLIDILTIIIFTAGPQHSAIAWTQYQYMAFIPNMPGAIYQPIPTTKGKFADENSLTSFLPGIKPSLTQVQFMSLVGTKRDPKAFTDFGVNSFQDPQAIRVLRDFQNRLESIEKRIEAQNQRREECYPAFLPSRMSNSVSG

SEQ ID NO: 191 - DNA, 1893 bp, Nostoc sp. PCC7524
  CDS (1)..(1893)
atgaatgtggcatcagcagataattcgagaagttcccccagcaaccacaacttggatatagctaggcagcaatatcaatataactacacccatattccccctttggcgatggtgaatcaactgccacctgcggaagagttcaccactcgttggtattgtttattagctaaagaattacgcctgatttttatcaataccctgattgtcaaccggggtaatcgtggttttaagtcggtgaaagatgatgtcattgcgtttcttttagaagctttgattaagggagccatcccatttcgcctgggtgtaattgccagactgctgcaaattctcccccaatttctgctgcgtagcgtctctaaagatttgcgggaactggatgatctgtttttatcactacttaaggaaattggactgtcaatttttacagattcactcaaccgcatcactaagctgttatttgagaaacaacccaaaggacgcgtaaccagtctcaaggattacgaaaaattgctaccagtgttgggattgcccaagattgccagcacttatcaagaagatgaagtttttgcttatatgcaagtggctggttataatcccttaatgattaagcgggtaactagcccaggcgatcgcttcccagtcacagacgagcattaccaagccgtgatgggtagtgatgattccttagcagcagccggggaagacggtagactttatctggcagactatgggattttagatggtgcgatcaatggtacacacccaaaactacaaaagtatgtctacgcacctctggcactgtttgctgtacccaaaggcgcagatgctcaccgtttactccgcccagtagccattcaatgtggacaaaccccagacgcagatcaccccatcattacccctaactctggtaaatacgcctggctgtttgccaaaactattgtcctcatcgccgatgccaactttcacgaagccgtcagccacctagctagaacacacctgtttgtgggtgtattcgtgatggcaacccatcggcaactcccaagcaatcatcccctcagcctgttgttacgcccccatttcgagggtacattagccatcaataatgccgcccaagagaacctcatcgctcgtgatggaggtgttgatctattactttcatcaactattgataactctcgtattttagccgtgcgtggattgcaaagctataacttcaacgcagccatgttacccaagcaactcaaacagcgtggtgtggatgatcccaacctattacctgtttatccttaccgagatgatgccctgttaatctgggatgctatccgtgattgggtgtcagactacctcaagctttactatcctacagatgcagatgtggaaaaagacgcagccttacaagcatgggcaaccgaagcccaagcttacgaaggtggtagaattactggctttggtgaagatggaggtatcaaaaccagagaatatctaattgatgcggtaacactgatcattttcaccgccagtgttcaacacgcggcggtaaactttccccagaaagatatcatgggctatgccccagttgtcccactagccggttatatgccagcctcaaccctcaagggagaagtgactgagcaagactacctcaacttgctgcctccactagaacaagcacaagggcaatataacttactttacttattaggatctgtgtattacaacaaactcggtcaatatccacaaccacactttactgatccacaagtaacatccttattgcaaagcttccaagataaactccagctaattgaagacaccatcaatcagcgcaatttaaaccgcccagcctatgaatatttgctcccttccaagattccccagagtattaatatttaa

SEQ ID NO: 192 - protein, 630 aa, Nostoc sp. PCC7524
MNVASADNSRSSPSNHNLDIARQQYQYNYTHIPPLAMVNQLPPAEEFTTRWYCLLAKELRLIFINTLIVNRGNRGFKSVKDDVIAFLLEALIKGAIPFRLGVIARLLQILPQFLLRSVSKDLRELDDLFLSLLKEIGLSIFTDSLNRITKLLFEKQPKGRVTSLKDYEKLLPVLGLPKIASTYQEDEVFAYMQVAGYNPLMIKRVTSPGDRFPVTDEHYQAVMGSDDSLAAAGEDGRLYLADYGILDGAINGTHPKLQKYVYAPLALFAVPKGADAHRLLRPVAIQCGQTPDADHPIITPNSGKYAWLFAKTIVLIADANFHEAVSHLARTHLFVGVFVMATHRQLPSNHPLSLLLRPHFEGTLAINNAAQENLIARDGGVDLLLSSTIDNSRILAVRGLQSYNFNAAMLPKQLKQRGVDDPNLLPVYPYRDDALLIWDAIRDWVSDYLKLYYPTDADVEKDAALQAWATEAQAYEGGRITGFGEDGGIKTREYLIDAVTLIIFTASVQHAAVNFPQKDIMGYAPVVPLAGYMPASTLKGEVTEQDYLNLLPPLEQAQGQYNLLYLLGSVYYNKLGQYPQPHFTDPQVTSLLQSFQDKLQLIEDTINQRNLNRPAYEYLLPSKIPQSINI

SEQ ID NO: 193 - DNA, 1893 bp, Nostoc sp. 210A
  CDS (1)..(1893)
atgactgcttcatcaccagaaaattcaatcagcttatcaagtactcatactttagatatagctaggcaagagtatcaatataactacacccatattccatctattgcgatgctagatcggctttctattgccgaagagttcgctactaactggtattttttattagcccagcagttacgagttgtgtttattaataccttgattgtcaacagaggcaatcaaggttctaaatcgattcgtgatgatgtcgaaaggtttattttagaagcctttctcaagggagcagtaccagtaaaaatcactattctggcaagaatcctgcaaattatccctcagtttttgctcaatggcatctctaaggatgttagagaactcgacgatcttttttattctattctgaaagaaaacggacttgtgatcctcagagatgctctaaataggataattaaccttctatacgaaggacagcctacaggacatgcaaccagtcttaaggactacgaaaatttgtttccggtgattggtgtgccaggaatcgctaaaacttaccaagaagatgaagtatttgcctatatgcgagtggctggctacaatcccgtcacgatcgcgcgagtaacgactccaggcgatcgcttcccagtcatagacgaacattaccaaggagtgatgggaactgacgattcattagcagcagccggacttgaaggcagactctacttagctgactataaaattttagatggtgcggtcaacggtacattcccacacgagcaaaaatatctctatgctcccctagcactatttgccttacccaaaggctcagaccccacccgtttattgcgtccaatagccattcaatgcggtcaaaccccagacccagattatccaattgttacccctaactccggtaaatactcttggctttttgccaaaacagtagtccaaatagcagatgcaaactaccacgaagctgttactcatctagcaagaactcacctgtttgttggtgtttttgcgatcgccaccgctcgacaattgccactcacccatcccctaagaattctcctgcacccgcattttgacagcactttagcaattaacgatgccgcccaacgtattctcatagctccaggcggtggtgtcgatagattactctcatcatcaatcgataactctcgcgttttagtagtgctagggttgcaaagctatggttttaatagcgccatcttacctaagcaattccaacagcgcggtgtagacgatcccaacctcttgcctgtttatccttaccgggatgatgcgctactagtctgggatgccattcatcaatgggttgcagactacctaaatctttactacaccaccgatgaagacattcaaaaagacacagcattgcaagcctgggcagccgaaatctcagcttacgatggtggtcgcatccccgattttggcgaagatgggggcatcaaaacgcgcaattacctgattgatgccactacgctgattattttcactgccagcgctcaacacgctgcggttaactttccgcaaaaagattttatgagctacgccgcagcgattccaatggcaggttatttaccagcctcaactctcaaaagagaagttactgagcaagactaccttaatttgctccctcccttagatcaggcgcaacggcaatacaacctactcagcttattgggatctgtgtattacaacaagctgggtgattatcagcaaggatactttacagaccagaaagtaaaaccattgctacaagcattccaaagtaatcttcagcaggtagaagataccatcaagcaacgtaatttgcaccgtccaccctatgagtatctacttccttctaaaattcctcagagcatcaatatctag

SEQ ID NO: 194 - protein, 630 aa, Nostoc sp. 210A
MTASSPENSISLSSTHTLDIARQEYQYNYTHIPSIAMLDRLSIAEEFATNWYFLLAQQLRVVFINTLIVNRGNQGSKSIRDDVERFILEAFLKGAVPVKITILARILQIIPQFLLNGISKDVRELDDLFYSILKENGLVILRDALNRIINLLYEGQPTGHATSLKDYENLFPVIGVPGIAKTYQEDEVFAYMRVAGYNPVTIARVTTPGDRFPVIDEHYQGVMGTDDSLAAAGLEGRLYLADYKILDGAVNGTFPHEQKYLYAPLALFALPKGSDPTRLLRPIAIQCGQTPDPDYPIVTPNSGKYSWLFAKTVVQIADANYHEAVTHLARTHLFVGVFAIATARQLPLTHPLRILLHPHFDSTLAINDAAQRILIAPGGGVDRLLSSSIDNSRVLVVLGLQSYGFNSAILPKQFQQRGVDDPNLLPVYPYRDDALLVWDAIHQWVADYLNLYYTTDEDIQKDTALQAWAAEISAYDGGRIPDFGEDGGIKTRNYLIDATTLIIFTASAQHAAVNFPQKDFMSYAAAIPMAGYLPASTLKREVTEQDYLNLLPPLDQAQRQYNLLSLLGSVYYNKLGDYQQGYFTDQKVKPLLQAFQSNLQQVEDTIKQRNLHRPPYEYLLPSKIPQSINI

SEQ ID NO: 195 - DNA, 1944 bp, Acaryochloris marina
  CDS (1)..(1944)
atgacgccacaatatgaatatcgatacgatgccctgaaagacgtttcccctgaattgaaatatccaatggccaaggaggtgtttccagcagaccaatctttgacaaaatggccctggactcgagacctcgtttccgttgtactcagaattattgccaatcaggccatgcaggatatatccgtccgccgaggatcagcctgtcgtctgattacgtttatccgcttgtatcgaattctagaaaatcccctctatcagtcaggtctggagcgggttttcaatgctatcaataatctcgtacggggtctctccaatatttttggcaacagagcccagtctcaaaatatcaagcatgatgtaaaggacgagcaacatcctgaaaaagtctccgcccgcatttccgccatagccaaggatatccaagaaacggctgagtcgagagaggcaagagagcaaacttctttagctgactatcgcgatctctttcagatcatttacttaccggacattagcaaccatttcctagaagatcgtgcctttgccgctcaacgggttgccggagccaaccccctcgtgattaaccgcatttctgaactcccagaccatttccaagtcactgaccaacagtttaaagctgtgatgggagatagtgagtccctccaagcagctttgaatgatggccgagtctatctggcagactatcaaattctagaagaaattgatgcgggtactgttgaggtaaaggatcgcgaaattccaaagtatagatatgcgccgttggccttatttgcgatcgcatccggaaattgtcccggtcgcctcctccaaccgattgccattcaatgccaccaagaagcaggcagcccgatatttacaccacccagtctagaagccgataaagaggagcggctcgcttggcgcatggccaagaccgtcgttcaaatcgccgatggtaactaccatgaattgatttctcatttagggcggactcatctctggattgagcccattgctttaggcacttaccgacgcctaggaacagagcatccactgggtaaattgctcctcccccacttcgaaggcaccttatttatcaacaatgcggcagccaatagcttaattgctccaggtggcaccgtagacaaaatcttatttggcaccttaaagtcatctgttcagctcagcgtcaaaggcgctaagggttaccccttttctttcaatgactccatgctcccccaaacctttgcatcgcgaggcgtggacgacctacaaaagctaccggactacccgtatcgagatgatgcattactgatttggcacgccattcacgattgggttgaggcctatcttcagatctactacaaagatgatgatgcagtcctcaaggatgacatcctccaggattggttagccgagctacgagctgaagatggaggccagatgactgaaatcggtgaatcaactccagaagaacccgagcctaaaattcgcaccttggattacctcattaatgcgacaacgctcattatttttacctgcagtgcccaacatgcatctgtcaacttccctcaagcatcattgatgacgttcgtccccaatatgcccctagcagggttcaatgaaggtccgacggcagagaaagccagtgaagcagattatttctctttactaccacccctgagtttggccgaacaacagttggatctagggtataccttgggttcggtctactatactcagctcggatattacaaagccaatgatgtggatttagatgatattaacgaccatacctacttcaaggacctccaagttaaacaggccctccgagacttccaacaaagattagaagaaattgagttgatcattcaagaccggaacgaaacccgacccacttattacgacatcttgctcccatccaagattccccaaagtaccaacatttaa

SEQ ID NO: 196 - protein, 647 aa, Acaryochloris marina
MTPQYEYRYDALKDVSPELKYPMAKEVFPADQSLTKWPWTRDLVSVVLRIIANQAMQDISVRRGSACRLITFIRLYRILENPLYQSGLERVFNAINNLVRGLSNIFGNRAQSQNIKHDVKDEQHPEKVSARISAIAKDIQETAESREAREQTSLADYRDLFQIIYLPDISNHFLEDRAFAAQRVAGANPLVINRISELPDHFQVTDQQFKAVMGDSESLQAALNDGRVYLADYQILEEIDAGTVEVKDREIPKYRYAPLALFAIASGNCPGRLLQPIAIQCHQEAGSPIFTPPSLEADKEERLAWRMAKTVVQIADGNYHELISHLGRTHLWIEPIALGTYRRLGTEHPLGKLLLPHFEGTLFINNAAANSLIAPGGTVDKILFGTLKSSVQLSVKGAKGYPFSFNDSMLPQTFASRGVDDLQKLPDYPYRDDALLIWHAIHDWVEAYLQIYYKDDDAVLKDDILQDWLAELRAEDGGQMTEIGESTPEEPEPKIRTLDYLINATTLIIFTCSAQHASVNFPQASLMTFVPNMPLAGFNEGPTAEKASEADYFSLLPPLSLAEQQLDLGYTLGSVYYTQLGYYKANDVDLDDINDHTYFKDLQVKQALRDFQQRLEEIELIIQDRNETRPTYYDILLPSKIPQSTNI

SEQ ID NO: 197 - DNA, 1896 bp, Rivularia sp. PCC 7116
  CDS (1)..(1896)
atgacagatttatcagaaaataatcaaaataatttgtcaccagtggataaattaaaacttgctaggcaagaataccagtataactatagccatattccacctattgcaatggtggatcaacttcctagtaatgagaatttctctactggctggctgcgtttgttagctaaagaattaaaagttgtttttatcaataccctaatcgcaaatcgaggaaatcgtggttccgaaagtgtccgcgacgatgtgagattatttctgatagaagtgttagctaaaggggcattaccgtttaatttaactgttagtgctagaattttacaaattattccgaatttattacttacaggaatatcaaaggattatagtgaaattgatgagttgttcttttccatacttagggaaagcggactttctatttttcaagattctctaagtcgagttaaaagtcttttatatgaaaaacgtcctaggggacatgcgaaaagcttaaatgattatcacaagctgttccccgagatgggaatacccaagatagccgagaatttctctacagacgaacaatttgcttatatgcgggtagctggatacaacccggtaatgattgagcaagtgaataaattgggcgatcgctttcccgttaccgaggctcaatatcgggaagtcatgggagatgattctttagcggcagcaggtgaagaaggaagactttatttagcagactatggaattttgaaaggtgctgttaacggtacttttccttcacagcaaaagtatatttacgctcccctagcactatttgcaattcctaaaaattccaatagcaataaaccaactttaatgcgtccagttgcgattcagtgcggtcaaaatccccaggataatccgattattacgcctaaatcagacaaatatgcttggctgtttgcaaaaactatcgtgcaaatcgcagatgctaactaccacgaagctgtaactcatttaggacgcactcatttacttgtaggtccttttgttgttgcaactcatcgtcagttaccggatagtcatccgcttaatatattactaagtcctcattttgaaggaactttagcgataaacgatgcagcccaacgtcgtttgattgctgctggtggaggtgtggataaattactggcatcgactattgataattcccgtgttttggcagcagtcggtttacaaagctatgggtttaatgaagccatgttacccaagcaattagagaaacgcggcgttaacgatacacaaaagctacctgtttacccataccgcgatgatgcgctgttagtttggaatacaattcatcaatgggttggtgactatttaaacatttactacaaaagcgatgcggatgttaaaaatgacaccaaacttcagaactgggctattgaagcaggggcttttgatggcggaagagttccagattttggtcaacaacatgggcttattcaaaccttagattacttaattgatgctattacgctgattatttttactgctagcgctcaacatgctgcggttaattttccccagggagacatgatgaactacgctccagcagtacccttagctggttatcagcctgcttcaattcttgaaggcaaagttaccgaagaaaactatttaaatttacttccacctttagaacaagcacaagaacaattaaacttagtccacttgttaggttctatttactatcaaactttaggtgattacccagagaattacttcaaagataccttagtaaaaccagctttgcaacaattccgaaataatttaattgaagttgaagctactattcatcaacgcaatcaaaatcgtcctacttacgaatatttgcttccttcaaaaattcctcaaagtattaatatttag

SEQ ID NO: 198 - protein, 631 aa, Rivularia sp. PCC 7116
MTDLSENNQNNLSPVDKLKLARQEYQYNYSHIPPIAMVDQLPSNENFSTGWLRLLAKELKVVFINTLIANRGNRGSESVRDDVRLFLIEVLAKGALPFNLTVSARILQIIPNLLLTGISKDYSEIDELFFSILRESGLSIFQDSLSRVKSLLYEKRPRGHAKSLNDYHKLFPEMGIPKIAENFSTDEQFAYMRVAGYNPVMIEQVNKLGDRFPVTEAQYREVMGDDSLAAAGEEGRLYLADYGILKGAVNGTFPSQQKYIYAPLALFAIPKNSNSNKPTLMRPVAIQCGQNPQDNPIITPKSDKYAWLFAKTIVQIADANYHEAVTHLGRTHLLVGPFVVATHRQLPDSHPLNILLSPHFEGTLAINDAAQRRLIAAGGGVDKLLASTIDNSRVLAAVGLQSYGFNEAMLPKQLEKRGVNDTQKLPVYPYRDDALLVWNTIHQWVGDYLNIYYKSDADVKNDTKLQNWAIEAGAFDGGRVPDFGQQHGLIQTLDYLIDAITLIIFTASAQHAAVNFPQGDMMNYAPAVPLAGYQPASILEGKVTEENYLNLLPPLEQAQEQLNLVHLLGSIYYQTLGDYPENYFKDTLVKPALQQFRNNLIEVEATIHQRNQNRPTYEYLLPSKIPQSINI

SEQ ID NO: 199 - DNA, 1893 bp, Tolypothrix bouteillei
  CDS (1)..(1893)
atgactgcttcatcacaagataattcgataaatgtcccaaatgcagataatctggacatagctaggcaagaataccaatatagctacacccatatcccacctctggctatggtggatcggctacctccagcagaagattttgcaagtgcctggtactttttgttggctcagcaagttaggggactatttgttaatactctaattactaaccgaggaaatcgcggctccgagtcgatccgtgatgatgtgagattgtttatcctggaagtattgctgaaaggagcaatacctttccaaaccaacattattgttaaagttttacaaattgtccctcagattttagctcaaggtatatctcgagattaccgagaactcgacgatctgttattttctatcctcaaagacagcggcatcacaattcttaaagattctttaaacaaagttattgagcttttgtacgaaggacaaccaactggacgccctaccagtttgaatgattacgaaaagttattcccagtgctgggagtccccgcgatcgcaacaacattccaagacgatgaagtgtttgcctatatgcgagttgcagggtacaatcccgtaatcattgagcgagtcagcagtcctggcgatcgttttccagtcacagaagaacattaccaggtggtgatgggaactgatgattcccttgcagcagccggagaagaaggaaggctctacttaacagattatggaattttagaaggaacgatcggcgggacattcccgtactatcaaaaatacctttacgctcccttagcactttttgcattacccaaaggctctgaccccaaccgtctgctgcgcccgatagccattcaatgcggtcaaactcccggtccagattatccgatcgtcacccctaactccggtaagtatgcttggctgtttgccaaaaccgttgtccagatagcagatgccaatgtccacgaagctgtcactcacctagccagaacacacttattcgttggtgcttttgtacttgcaacccatcgccaacttctccgcacccatcctttaagcgtacttctgcgtcctcatttcgagggaaccttagcaattaacgatgcagcccaacgagctttgattgctcctggtggtggagttgatagattgctttcagcaaccatcgataactctcgggttttagcggtgtacgggttgcaaagttacagtttcaataatgccatcctaccaaagcaatttaagcagcgaggcgtggaagatcccaatctattgcccgtatatccttaccgagatgatgcacttttggtttggaatgccattcatcaatgggtttcgagttacgtaaacctttactactccactaatgaggacattcaaaaagacgcagcccttcaagcatgggttgctgaagcccgatcttacgatggcggtcgcgtgtttgattttggtgaagatggaggtatcaagacacgagaatatctagcagatgcccttacgctgattattttcacagccagcgctcaacatgctgcggttaactttccccagaaaagtctcatgggttacgcagctgccgtaccactagcaggttacgcaccagcctcaactctcactaaggaagtgagtgaagaagactatctcaaattgctcgcacccctagatcaagcacaaaggcagtataatttactggctttgctgagtgctgtttactataacaaactcggtgaatacccgcaaggacactttacaaatccacaagtccaacctttactacaggaatttcagagcaatctcaagcaggttgaagcaactatcaatcagcgcaatttgaaacgcccaatctataattatttgctgccttccaaaattccccagagcattaatatttag

SEQ ID NO: 200 - protein, 630 aa, Tolypothrix bouteillei
MTASSQDNSINVPNADNLDIARQEYQYSYTHIPPLAMVDRLPPAEDFASAWYFLLAQQVRGLFVNTLITNRGNRGSESIRDDVRLFILEVLLKGAIPFQTNIIVKVLQIVPQILAQGISRDYRELDDLLFSILKDSGITILKDSLNKVIELLYEGQPTGRPTSLNDYEKLFPVLGVPAIATTFQDDEVFAYMRVAGYNPVIIERVSSPGDRFPVTEEHYQVVMGTDDSLAAAGEEGRLYLTDYGILEGTIGGTFPYYQKYLYAPLALFALPKGSDPNRLLRPIAIQCGQTPGPDYPIVTPNSGKYAWLFAKTVVQIADANVHEAVTHLARTHLFVGAFVLATHRQLLRTHPLSVLLRPHFEGTLAINDAAQRALIAPGGGVDRLLSATIDNSRVLAVYGLQSYSFNNAILPKQFKQRGVEDPNLLPVYPYRDDALLVWNAIHQWVSSYVNLYYSTNEDIQKDAALQAWVAEARSYDGGRVFDFGEDGGIKTREYLADALTLIIFTASAQHAAVNFPQKSLMGYAAAVPLAGYAPASTLTKEVSEEDYLKLLAPLDQAQRQYNLLALLSAVYYNKLGEYPQGHFTNPQVQPLLQEFQSNLKQVEATINQRNLKRPIYNYLLPSKIPQSINI

SEQ ID NO: 201 - DNA, 1893 bp, Leptolyngbya sp. PCC 7375
  CDS (1)..(1893)
atgactgcaagctataaaaatcaaaatctgcaagaaaaaaagcagcaatatcagtataactatacccatatcccacctgtggccatggtagacaaactgtcagaagaggaggggttttctcctggatggcggttgttagtggccaaggttgggtttgaactcctcgttaacaccattattgctaatcgtggagatcagggtaaatctggagcagccgatgatgtcaaaatatttctgatagaaacggttaaggaaacattggtagattacaaaggtttttctcgcctgaagattctctggcaaggggcaaaatatacccctagactcttatttggcagattatctatcaatgtagaagagattgaagatctgattacagatattatcaaaagtgtcagcgctgatttcctccgagattttgcagctaacgtacagcaaaaattaatactggactctcctaaaggtaaaggggatgacctcaaagattttcaggagctatttcaaaccattgatctacctgccatcgcttatacctatgaggaggatgaggtatttgcatccatgcgggtagctgggcctaatccggtcatgctacagcgactgacagaacctgaggcacggctgccgatcacagaggctcaatatcaagccgtcatgggagcaacggattctctgacagaggcctatgcagagggacgtgtatacctgacggattacgccattctagagggggcaatcaatggctcatttcccgccgatcagaaatatctatacgcccccctagccctatttgctgtaccgaaagccgatgtgggcgatcgtcgtctgcgtccggtggccattcaatgtgggcaaaaccctaatgattttcccatccacacgcccaaatcaaatccctatgcatggctctgcgctaagaccattgtgcaggttgccgatgcgaacttccatgaggcggttacccatctggcgcggactcatttgttcattgggccatttgcgatcgcaacccaccgccaactccccgacaatcatcccctcagtcttctcctgcgcccccacttccaaggcatgctggccatcaacaacgaagcccaggccaagctgattgctgccggtggtggcgttaacaaaattctctcagcaaccatcgacacgtcccgagtatttgccgtcctgggggtacaaacctatggcttcaattccgccatgttccccaagcagctgcaacagcgcggtgtagacgacaccaacagcctacccatctacccctaccgtgatgacggtagcttaatttgggacgccatccacaattgggtagaggactatctcaagctgtactatgccgatgacgctgcagtacagcaagatgctaatttgcaagcctgggcacaggaactcattgcttatgatggcggtcgcgtcatagagtttggcgaaactgacgaacaactgcaaacgctgctgcaaacccttacgtatctcattgatgccattactctgattatttttaccgccagtgctcaacacgccgctgtgaatttcccccaaaaggacatcatgagcttcaccccagcgatgccgaccgctggctatgatgagttaccagatctgggagaccagaccacaaaagaagattacctgagtttgttaccgcctttaaaccaagcccaagagcagctcaagctattgcacttgcttggctccgtgcattttacagaattaggccagtacgaaaagggacattttcaagacagtcaagtacaagcccccttgcaacgtttccagaatcgattagaagaaatcacagatgtgatctaccagcgcaatcgcaatcgtcccgcctacgaatatctattacccaagaatattccccaaagcatcaatatctag

SEQ ID NO: 202 - protein, 630 aa, Leptolyngbya sp. PCC 7375
MTASYKNQNLQEKKQQYQYNYTHIPPVAMVDKLSEEEGFSPGWRLLVAKVGFELLVNTIIANRGDQGKSGAADDVKIFLIETVKETLVDYKGFSRLKILWQGAKYTPRLLFGRLSINVEEIEDLITDIIKSVSADFLRDFAANVQQKLILDSPKGKGDDLKDFQELFQTIDLPAIAYTYEEDEVFASMRVAGPNPVMLQRLTEPEARLPITEAQYQAVMGATDSLTEAYAEGRVYLTDYAILEGAINGSFPADQKYLYAPLALFAVPKADVGDRRLRPVAIQCGQNPNDFPIHTPKSNPYAWLCAKTIVQVADANFHEAVTHLARTHLFIGPFAIATHRQLPDNHPLSLLLRPHFQGMLAINNEAQAKLIAAGGGVNKILSATIDTSRVFAVLGVQTYGFNSAMFPKQLQQRGVDDTNSLPIYPYRDDGSLIWDAIHNWVEDYLKLYYADDAAVQQDANLQAWAQELIAYDGGRVIEFGETDEQLQTLLQTLTYLIDAITLIIFTASAQHAAVNFPQKDIMSFTPAMPTAGYDELPDLGDQTTKEDYLSLLPPLNQAQEQLKLLHLLGSVHFTELGQYEKGHFQDSQVQAPLQRFQNRLEEITDVIYQRNRNRPAYEYLLPKNIPQSINI

SEQ ID NO: 203 - DNA, 1893 bp, Nostoc sp. DB3992
  CDS (1)..(1893)
atgactgcttcatcaccagaaaattcaattagctcatcaagtactcatactttagatatagctaggcaagagtatcaatataactacacccatattccatctattgcgatgctagatcggctttctattgccgaagagttcgctactaactggtattttttattagcccagcagttacgagttgtgtttattaatactttgattgtcaacagaggcaatcaaggttctaaatcgattcgtgatgatgtcgaaaggtttattttagaagcctttctcaagggagcagtaccagcaaaaatcagtattttggcaagaatcctgcaaattatccctcagtttttgctcaaaagtatatctaaggatgttagagaactcgacgatcttttttattctattctgaaagaaaacggacttgtaatcctcagagatgctctaaataggataattaaccttctatatgaaggacaacctacaggacatgcaaccagtctcaaggattatgaaaatttgtttccagtgattggtatgccagcgatcgctaaaacctaccaagaagatgaagtatttgcctacatgagagtcgctggctacaatcccgtcacgatcgcgcgagtaacgactccaggcgatcgcttcccagtcacagacgaacattaccaagcagtgatgggaactgacgattcactagcagcagccggacttgaaggcaggctctacttagctgactataaaattttagatggtgcggtcaacggtacattcccacacgagcaaaaatatctctatgctcccctagcactatttgccttacccaaaggctcagaccccacccgtctattgcgtccaatagccattcaatgcggtcaaaccccaggcccagattatccaattgttacccctaactccggtaaatactcttggctttttgccaaaacagtagtccaaatagcagatgcaaactaccacgaagctgttactcatctagcaagaactcacctcttggttggtgtttttgcgatcgccaccgctcgacaattgccactcacccatcccctaagaattctcctgcacccgcattttgacagcactttagcaattaacgatgccgcccaacgtattctcatagctccaggcggtggtgtcgatagattactctcatcatcaatcgataactctcgcgttttagcagtgctagggttgcaaagctatggttttaacagcgccatcttacctaagcaattccaacagcgcggtgtagacgatcccaacctcttgcctgtttatccttaccgggatgatgcactattagtctgggatgccattcatcaatgggtttcagactacctgaacctttactacaccacggatgaagacattcaaaaagacacagcattgcaagcgtgggcagttgaaatctcagcttacgatggtggtcgcatccgcgattttggcgaagatgggagcatcaaaacgcgcaattacctaattgatgccactacgctgattattttcactgccagcgctcaacacgctgccgttaactttccgcaaaaagattttatgggctacgccgcagccataccattggcaggttatttaccagcctcaactctcaaaagagaagttactgagcaagactaccttaatttgctccctcccttagatcaggcgcaacggcaatacaacctactcagcttattggggtctgtgtattacaacaagctgggtgattatcagcaaggatactttacagaccagaaagtaaaaccattgctacaagcattccagagtaatcttcagcaggtagaagataccatcaagcaacgtaatttgcaccgtccaccctatgagtatctgcttccttctaaaattcctcagagcatcaatatctga

SEQ ID NO: 204 - protein, 630 aa, Nostoc sp. DB3992
MTASSPENSISSSSTHTLDIARQEYQYNYTHIPSIAMLDRLSIAEEFATNWYFLLAQQLRVVFINTLIVNRGNQGSKSIRDDVERFILEAFLKGAVPAKISILARILQIIPQFLLKSISKDVRELDDLFYSILKENGLVILRDALNRIINLLYEGQPTGHATSLKDYENLFPVIGMPAIAKTYQEDEVFAYMRVAGYNPVTIARVTTPGDRFPVTDEHYQAVMGTDDSLAAAGLEGRLYLADYKILDGAVNGTFPHEQKYLYAPLALFALPKGSDPTRLLRPIAIQCGQTPGPDYPIVTPNSGKYSWLFAKTVVQIADANYHEAVTHLARTHLLVGVFAIATARQLPLTHPLRILLHPHFDSTLAINDAAQRILIAPGGGVDRLLSSSIDNSRVLAVLGLQSYGFNSAILPKQFQQRGVDDPNLLPVYPYRDDALLVWDAIHQWVSDYLNLYYTTDEDIQKDTALQAWAVEISAYDGGRIRDFGEDGSIKTRNYLIDATTLIIFTASAQHAAVNFPQKDFMGYAAAIPLAGYLPASTLKREVTEQDYLNLLPPLDQAQRQYNLLSLLGSVYYNKLGDYQQGYFTDQKVKPLLQAFQSNLQQVEDTIKQRNLHRPPYEYLLPSKIPQSINI

SEQ ID NO: 205 - DNA, 1839 bp, Nostocales
  CDS (1)..(1839)
atgctgccaactttaccgcagaatgatcccaatcctagtgtgcgtcaagcacaattggctcgcagccgatatatctacaaatttactcataagtaccaaggctgtcccggaaattcacctttacctaatgggattgcgctggcagaacatgttcctcctgatcaggagtttactccagactatcttttgcgggttactcaggttaacgccaccttactggcaaaccacgcagccatcgacctggagtatctcacaggaggaaacgcaggtagcagcttttcgctgtctgattggttaggattaactcgggctgtaggcaataaacacttacttttttccacaccgctcaaggtgacttccaggatagatagttcttttccgattaatttggatgcctacgatgcaatgtttgcgttgatccagaaacctgagattgtttacaagttaaagcaaggcagggatgtttgcgatcgcgcttttgcctggcaaaggctggctggtgctaatccgatggttttgcaaggtattactcatttaccaccgacgtttcagcttactaaccagcaatatcaagctgctattagagatgagaacgacacccttgaagctgctggtaaggaagggaggctttacgttgctgactactcgctgcttagtgggcttcctcacggtacttggagtgatggcgttcttggtgtgcctcgtaataagtatatctttgacccaatcgctctatttgcttggaaaaaagaaactccactggaattaggagggttattacccgtagcaattcaatgccaacaaactcaagattctatttcgtggtgtcgttcggttgcaccaatctttactcctaatgatggaatcttctgggaaatggctaaagctattgtccaatccgctgatggtaacattcaggaaatggtctaccatttagggcacacgcactttgtaatggaagccgtaattgttgccgcagagcgcaatctagctgctgttcatccaattcatgtactgcttaagccccattttgaatttacgctatcactaaatgactatgcatacaagcacctaattgcaccaggtggtgcagttgattcggtgatgggttcaacacttgaaggcagcttaactcttatgcttcggggtatgaaaaactatgcttttaatcaagctctacctcccctagatttcaaaaatcgtggcgttgataatttagatgggttacctgagtatccttatcgcgatgatggtttattagtttggacggcaattcgtaagtttgtatccaaatatctccggctctactataccaatgatattgatgtcaaaaccgataccgaactccaaaactgggtcaaaagtattggcaatagtcaagaaggaaatattcaaggagtggaggaaatccaaaccttagaaaagctgattgatatggtagccttaatcatttttaccgcttcagcacagcatgggtcactcaactacgcacaattcccaatgatgggttatgtaccgaatgtgtctggagcaatttacgcagaagctcccacaaatacaactcctcagaatcaagacaattatttaatgttgttggctcccgtacaacaagccctgatacagttcacaactctatatcaattgtcgaacgtacgctacggtaaattaggtcattatccctgcttatattttcaagattcgcgagtacttcctttagtcaaggaattccagcagaacttagctgttgttgagtcagaaattcttgatcgcgaccaaactcgttttatgtcatatccttttctgcttccctctcaaattgggaacagcatctttatttga

SEQ ID NO: 206 - protein, 612 aa, Nostocales
MLPTLPQNDPNPSVRQAQLARSRYIYKFTHKYQGCPGNSPLPNGIALAEHVPPDQEFTPDYLLRVTQVNATLLANHAAIDLEYLTGGNAGSSFSLSDWLGLTRAVGNKHLLFSTPLKVTSRIDSSFPINLDAYDAMFALIQKPEIVYKLKQGRDVCDRAFAWQRLAGANPMVLQGITHLPPTFQLTNQQYQAAIRDENDTLEAAGKEGRLYVADYSLLSGLPHGTWSDGVLGVPRNKYIFDPIALFAWKKETPLELGGLLPVAIQCQQTQDSISWCRSVAPIFTPNDGIFWEMAKAIVQSADGNIQEMVYHLGHTHFVMEAVIVAAERNLAAVHPIHVLLKPHFEFTLSLNDYAYKHLIAPGGAVDSVMGSTLEGSLTLMLRGMKNYAFNQALPPLDFKNRGVDNLDGLPEYPYRDDGLLVWTAIRKFVSKYLRLYYTNDIDVKTDTELQNWVKSIGNSQEGNIQGVEEIQTLEKLIDMVALIIFTASAQHGSLNYAQFPMMGYVPNVSGAIYAEAPTNTTPQNQDNYLMLLAPVQQALIQFTTLYQLSNVRYGKLGHYPCLYFQDSRVLPLVKEFQQNLAVVESEILDRDQTRFMSYPFLLPSQIGNSIFI

SEQ ID NO: 207 - DNA, 1893 bp, Nostoc punctiforme
  CDS (1)..(1893)
atgactgcttcatcaccagaaaattcaattagctcatcaagtactcatactttagacatagctaggcaagagtatcaatataactacacccatattccatctattgcgatgctagatcggctttctattgccgaagagttcgctactaactggtattttttattagcccagcagttacgagttgtgtttattaataccttgattgtcaacagaggcaatcaaggttctaaatcgattcgtgatgatgtcgaaaggtttattttagaagcctttctcaagggagcagtaccagtaaaaatcagtattctggcaagaatcctgcaaattatccctcagtttttgctcaaaagcatatctcaggatgttagagaactcgacgatcttttttattctattctgaaagaaaacggacttgtaatcctcagagatgccctaaataggataattaaccttctatatgaaggacaacctacaggacatgcaaccagtctcaaggactacgaaaatttgtttccggtgattggtgtgccagcgatcgctaaaacttaccaagaagacgaagtatttgcttacatgcgagtggctggctacaatcccgtcacgatcgcgcgagtaacgactccaggcgatcgcttcccagtcacagacgaacattaccaaggcgtgatgggaactgacgattcattagcagcagccggacttgaaggcagactctacttagctgactataaaattttagatggtgcggtcaacggtacattcccacacgagcaaaaatatctctatgctcccctagcactgtttgccttacccaaaggctcagaccccacccgtttattgcgtccgatagccattcaatgcggtcaaacaccagacccagattatccaattgttacccctaactgcagtaaatactcttggctttttgccaaaacagtagtccaaatagcagatgccaactaccacgaagctgttactcatctagcaagaactcacctgtttgttggtgtttttgcgatcgccaccgcaagacaactgccactcacccatcccctaagaattctactgcacccgcattttgacagcactttagcaattaacgatgctgctcaacggattctcatagctccaggcggtggtgtcgatagattactctcatcatcaatcgataactctcgcgttttagcagtgctaggcttacaaagctatggttttaacagtgccatcttacctaagcaattccaacagcgtggtgtagacgatcccaacctcttgcctgtttatccttaccgggatgatgcactattagtctgggatgccattcatcaatgggtttcagactacctaaacctttactacaccaccgatgaagacattcaaaaagacagagcattgcaagcgtgggcagccgaaatcccagcttacgatggtggtcgcattcccgattttggcgaagatggaggcatcaaaacgcgcaattatctaattgatgccactacgctgattattttcactgccagcgcccaacacgctgcggttaactttccgcaaaaagattttatgggctacgccgcagcgattccaatggcaggttatttaccagcctcaactctcaaaagagaagttactgagcaagactaccttaatttgctccctccgttagatcaggcgcaacggcaatacaacctactcagcttattggggtctgtgtattacaacaagctgggtgattatcagcaaggatactttacagaccagaaagtaaaaccattgctacaagcattccagagtaatcttcagcaggtagaagatacgatcaagcaacgtaatttgcgccgtccatcctatgagtatctacttccttctaaaattcctcagagcatcaatatctga

SEQ ID NO: 208 - protein, 630 aa, Nostoc punctiforme
MTASSPENSISSSSTHTLDIARQEYQYNYTHIPSIAMLDRLSIAEEFATNWYFLLAQQLRVVFINTLIVNRGNQGSKSIRDDVERFILEAFLKGAVPVKISILARILQIIPQFLLKSISQDVRELDDLFYSILKENGLVILRDALNRIINLLYEGQPTGHATSLKDYENLFPVIGVPAIAKTYQEDEVFAYMRVAGYNPVTIARVTTPGDRFPVTDEHYQGVMGTDDSLAAAGLEGRLYLADYKILDGAVNGTFPHEQKYLYAPLALFALPKGSDPTRLLRPIAIQCGQTPDPDYPIVTPNCSKYSWLFAKTVVQIADANYHEAVTHLARTHLFVGVFAIATARQLPLTHPLRILLHPHFDSTLAINDAAQRILIAPGGGVDRLLSSSIDNSRVLAVLGLQSYGFNSAILPKQFQQRGVDDPNLLPVYPYRDDALLVWDAIHQWVSDYLNLYYTTDEDIQKDRALQAWAAEIPAYDGGRIPDFGEDGGIKTRNYLIDATTLIIFTASAQHAAVNFPQKDFMGYAAAIPMAGYLPASTLKREVTEQDYLNLLPPLDQAQRQYNLLSLLGSVYYNKLGDYQQGYFTDQKVKPLLQAFQSNLQQVEDTIKQRNLRRPSYEYLLPSKIPQSINI

SEQ ID NO: 209 - DNA, 1812 bp, Gemmata sp. SH-PL17
  CDS (1)..(1812)
atggcgcgaaccgctcggtaccggttcggacccgaattgcccggcgcccgacccgatgcccaggtggttcacccgatgagcgcatttctgcccgcgttcgatccggacccggaaacccgtgccgccgggcgcgccgcgaagcggggcgagtacacgtacaaccacgaatacgtttcgccgctcgcgttcgtcggggaggtgcccagccgcgaccggttccccatcgatttcaccacgctcgttctcggcaagatcatgacgaacgtggcgaaccaggcggacgcggattccgcgctgcgccggcgcctgcgcgcgatggacgtcccgatcgccgacatggtgctcgccgggtcgacggccgttcgcgccgtcggcgccgcggtgggtgccgtgatcggggcggcggcggatgcccgtcggttgcaaacgatcgacgactacaacgctctcttccacgtcatcgggctgccgccgatcgcgaaggactttgaattcgacagcacgttcgcggaattgcggctcgccgggccgaacccggtgatgattcaccgggtcgacaagccggacgatcgattcccggtcacggacgcgcattttcaggtcgcactgcccggcgacaccctcgcggcggccggggcggaagggcgactgtttctggtggactaccagagacttgacggggtcgagaccggtgtaagcccgtgcgggctgccgaagtacctctacgccccgctcgcgctgttcgcggtgaacaaggacacgcgaaaactggtcccggtcgcgatccagtgcaagcagcggccgggaccggagaacccgatcttcacgccggacgacggctacaactggcggatcgccaagacgatcgtggaaatcgccgacggcaactaccacgaggcgatcacgcacctcgggcgcacgcacctgacggtcgagccgttcgtggtcgcggcgcaccggcagttcggtccgaaccacccgctcaatgtgctgctccaaccgcacttcggtggcacactcgcgatcaatcacctcgcgcgtctcaaactgatttcgcccgatggcgtcgtggaccggctcctcggcgcgaagatctccgcggcgctggaactcagcgcgtggggggtgcagggccacgccttcatggatttgctgccgccggcgtcgtttcggcgccgcggggtcgataacacggccaccttgccgagctactcctaccgcgatgacgccctcttgcactgggaggccgttcgcgagtgggtcgcgacgtacctgcggtgcttctaccggtccgatgccgaagtcgcggcggacgtggaagtcgcggcgtggctcacggaggcgtccgcgaagaccggcgggcgcatcaacgggatcgaaccggcccgcaccttcgcggaactggtcgacgtgaccgcccttgtgattttcaccgcgagcgcgcagcacgcggcggtgaacttcccgcaatacgacatcatgagttacgcccccgcgatgccgctcgcgggttacgccccggcgcccacgagcaagaccggcgccacagaagccgactacatggcgatgctgccaccgcgggaccaggccgcgctccagatgaacaccggcttcatgctcggaacggcgcactacacgcggctggggcactacgaaccggggtacttcggcgaaccgcgcattaacgaactagcggcgcgattcgcggcgaagatggacgagatcgaggccaccatcacggaaagaaaccggcaccgccggccgtacccgtttatgctgccatcgggtgtgccgcagagcatcaacatttga

SEQ ID NO: 210 - protein, 603 aa, Gemmata sp. SH-PL17
MARTARYRFGPELPGARPDAQVVHPMSAFLPAFDPDPETRAAGRAAKRGEYTYNHEYVSPLAFVGEVPSRDRFPIDFTTLVLGKIMTNVANQADADSALRRRLRAMDVPIADMVLAGSTAVRAVGAAVGAVIGAAADARRLQTIDDYNALFHVIGLPPIAKDFEFDSTFAELRLAGPNPVMIHRVDKPDDRFPVTDAHFQVALPGDTLAAAGAEGRLFLVDYQRLDGVETGVSPCGLPKYLYAPLALFAVNKDTRKLVPVAIQCKQRPGPENPIFTPDDGYNWRIAKTIVEIADGNYHEAITHLGRTHLTVEPFVVAAHRQFGPNHPLNVLLQPHFGGTLAINHLARLKLISPDGVVDRLLGAKISAALELSAWGVQGHAFMDLLPPASFRRRGVDNTATLPSYSYRDDALLHWEAVREWVATYLRCFYRSDAEVAADVEVAAWLTEASAKTGGRINGIEPARTFAELVDVTALVIFTASAQHAAVNFPQYDIMSYAPAMPLAGYAPAPTSKTGATEADYMAMLPPRDQAALQMNTGFMLGTAHYTRLGHYEPGYFGEPRINELAARFAAKMDEIEATITERNRHRRPYPFMLPSGVPQSINI

SEQ ID NO: 211 - DNA, 1875 bp, Pseudanabaena sp. BC1403
  CDS (1)..(1875)
atgatcttctcgcttttgagtggtgttgccagagtattaaatttcgtttcggctaagttaacagacttagccaatttaatatcaaggcgatcgcagtcaagcaaatacccgctgttgcctcagaatgatcccgcaactactcagcgtcaagcatctctaaatcaatctaggcaactctatcaatataactacacctatattgagtcattgccaatggtagagaaggttcccaagaatgagagattttctctatcttggggattattagttgggaaggtagtggtcaaagttttgttaaatgatcgagctaatccttcggcattcattgacaaagagaaatctaaagcacaacaactagacttctcaaaacgtttgcttgaagctagcatgtctcagtctgaaaatgcattaatagaactattgtccgaattgccaacaattcttgaagatgagccaattgatttagaagggtcaaacattcaagaatacaacaatcttttttggattattcctctacctgcaatcagtcaaaattttaagagcaattcagaatttgcaaggttacgcgttgctggctttaatcctctagtgattcaaaaggttaaggctttggatgccaaattccccttgactgaggcgcaattccagaaggttttggctggtgattctttagctgcggcaggagcagaagggcgtttgtatttggctgattatgtagaactaaccgcgatcgcaggcggcactttccctaaatcagaacagaaatatatcaacgcacctttagctctatttgcgattcctaaagggaaaaagagcctgactccgatcgccattcaactaggacaagatccgaatactaatcccatctttgtctgtcaagctggtgatgagccaaactggatgctagcaaaaactgttgtccaaattgccgatgctaattaccatgaactaattagtcatttgggtagaactcatctatttatcgagccttttgcgatcgctactaatcgccaactcgccagtaatcatcctctatatgttttactaaagccacattttcaagggactttagcgattaatgatgcggctcagtcaggactgattaatgcaggtggaaccattgatagtctattagcaggcacgattacttcgtctcgcgcactttcagttcagggtgtaaaaacctataactttgatgaggcgatattgcctgtagctttgaagaagagaggagttgatgatccaaacctattgccagactatccctatcgcgatgatgctttgttagtttgggatgctatttcaacttgggttaaaagctatctatcgatctattacttcaatgacaatgatgtgattagagattcggaactgcaagcttgggcacaggaaatcatttctgacaatggtggtcgcgtaactagtttcggacagagtggacagattcgcacttttgattatttagtcaatgctgtaactctactaatctttactggtagtgctcaacatgcggcggtgaacttcccccaaggcgacttgatggtttatgctcccgcatttcctctagctggctatacccctgcaccaacttcaaccacaggtgcaagcgaggcagatttctttgcaatgttgcctcctatcgatcaggctaagagccaattgacgatgacttatattcttggttcggtctattacacgaccttgggtgagtatgggcctagttatttcaatgacgatcgcattaagcagcccctactcgatttccaagatcagttaaaggcgatcgagtcaacaatcaagtctcgtaatgaaaaacgagttacggactataactatttgagaccatcacggattcctcaaagtattaatatctaa

SEQ ID NO: 212 - protein, 624 aa, Pseudanabaena sp. BC1403
MIFSLLSGVARVLNFVSAKLTDLANLISRRSQSSKYPLLPQNDPATTQRQASLNQSRQLYQYNYTYIESLPMVEKVPKNERFSLSWGLLVGKVVVKVLLNDRANPSAFIDKEKSKAQQLDFSKRLLEASMSQSENALIELLSELPTILEDEPIDLEGSNIQEYNNLFWIIPLPAISQNFKSNSEFARLRVAGFNPLVIQKVKALDAKFPLTEAQFQKVLAGDSLAAAGAEGRLYLADYVELTAIAGGTFPKSEQKYINAPLALFAIPKGKKSLTPIAIQLGQDPNTNPIFVCQAGDEPNWMLAKTVVQIADANYHELISHLGRTHLFIEPFAIATNRQLASNHPLYVLLKPHFQGTLAINDAAQSGLINAGGTIDSLLAGTITSSRALSVQGVKTYNFDEAILPVALKKRGVDDPNLLPDYPYRDDALLVWDAISTWVKSYLSIYYFNDNDVIRDSELQAWAQEIISDNGGRVTSFGQSGQIRTFDYLVNAVTLLIFTGSAQHAAVNFPQGDLMVYAPAFPLAGYTPAPTSTTGASEADFFAMLPPIDQAKSQLTMTYILGSVYYTTLGEYGPSYFNDDRIKQPLLDFQDQLKAIESTIKSRNEKRVTDYNYLRPSRIPQSINI

SEQ ID NO: 213 - DNA, 1875 bp, Leptolyngbya sp. Heron Island J
  CDS (1)..(1875)
atgactgcaagctactccaacccagaccaacataaaaaacgtttagaatatcaatacaactatacccatattccgcccatagctatggtggataagctatcagaggaagagcaattttcttcgcgatggcgtttgatggtggctaaagttggttttgaaatactggttaatacgattattgtcaatcgaggtgatcaaggtaaatcaggagccgcagacgatgttaaagcctttctcatagagacttttcaggagactttagcagactattcagtgaggtctcggctgaaaatcctctggcagggagcaaagtttatacccaggattctatttacgcggttatccttaaaggcagaagagctagaaaacctgatcaaagagattattcagagtgtcaatggcgattttctacgagattttgccgccaatgtgcaacagaagttaaaactcgatgcgcctgtagggcgcggccaggacattaaagattttcaggctctgtttcaaacgattgacttaccagacatcgcctacacctacgaaaccgatgaggtgtttgcatcaatgcaggtagccgggccaaatccagtcatgatcaagcggctgtcaacaccggatgctcgtctgcccatcacagagactctgtacaaagggggcatgggagaaacggattccctggccgatgcctatgctgaaggacgtttatacctagctgattatggcattctggatggagccatcaacggttcatttcctgaggcgcagaaatatctctacgcgccacttgcgttatttgctgtagcaaaaacgggcgatcgccgtttgcggccagtagcaattcaatgtgggcaaaatcccgaggagtttcctctttataccccgcaatcaaatccctatgcctggctctgtgcaaagaccatggtgcagattgctgatgctaatttccatgaggcagtcacccatctggcacgtactcatttgttgattggaccatttgcgatcgcaacccaccgccaactatccgacgaccatcccctcagcctcctgctccgcccccacttccagggcatgctagccatcaataacgaagcccaagccaagctgatcgcccctggcggtggcgtcaacaagattctctcagccaccatcgatacctcgcgagtatttgctgtcatcggcgtccagacctacggctttaactccgccatgttacccaaacaacttcagcagcgcggagtagacgatacagatagcctccccatttacccctaccgtgacgacagcatcttaatttgggacgccattcatgactgggccgaaaactatctcagcctctactatgccaatgatgcggccgttcagcaggataacgctctacaggcatgggcacaggaactaagcgcccacaatggcggtcgcgtccaagaattcggcgaagccgaagggcagctccaaacccttgcatatctgattgacgccatcacgctgattatattcaccgctagcgcccaacatgcagcagtcaatttcccccaaaaggaaatcatgagctacgccccagccatgccaaccgctggctatgccgcattagaaaatctcggagagcacaccactcaagcaaactacctgagcttattaccccccatcgaccaagcgcaggagcaacttaagttattgcatctgctaggctctgtccacttcacacagttaggacagtacgagaaaaatcatttccaggatgccaatatcaaaatcccgctagaacagtttcaaaaccgtctcgaagagattacagatattatccatgagcgtaatcgcgatcggtctccctacgagtatttactacccaaaaatattccccaaagcatcaatatctag

SEQ ID NO: 214 - protein, 624 aa, Leptolyngbya sp. Heron Island J
MTASYSNPDQHKKRLEYQYNYTHIPPIAMVDKLSEEEQFSSRWRLMVAKVGFEILVNTIIVNRGDQGKSGAADDVKAFLIETFQETLADYSVRSRLKILWQGAKFIPRILFTRLSLKAEELENLIKEIIQSVNGDFLRDFAANVQQKLKLDAPVGRGQDIKDFQALFQTIDLPDIAYTYETDEVFASMQVAGPNPVMIKRLSTPDARLPITETLYKGGMGETDSLADAYAEGRLYLADYGILDGAINGSFPEAQKYLYAPLALFAVAKTGDRRLRPVAIQCGQNPEEFPLYTPQSNPYAWLCAKTMVQIADANFHEAVTHLARTHLLIGPFAIATHRQLSDDHPLSLLLRPHFQGMLAINNEAQAKLIAPGGGVNKILSATIDTSRVFAVIGVQTYGFNSAMLPKQLQQRGVDDTDSLPIYPYRDDSILIWDAIHDWAENYLSLYYANDAAVQQDNALQAWAQELSAHNGGRVQEFGEAEGQLQTLAYLIDAITLIIFTASAQHAAVNFPQKEIMSYAPAMPTAGYAALENLGEHTTQANYLSLLPPIDQAQEQLKLLHLLGSVHFTQLGQYEKNHFQDANIKIPLEQFQNRLEEITDIIHERNRDRSPYEYLLPKNIPQSINI

SEQ ID NO: 215 - DNA, 1923 bp, Calothrix sp. NIES-4101
  CDS (1)..(1923)
atgcgatcgccaactccaaagcaacgacgacaagagttaatagatacatatattttatcacgtcgtagcatgatgatgctaatggctgtagctgctactccgggtatagaaatgttactgttcggtgggaataaatcctcacaagctagtgcaacaggtaattttgaaaattgcaatccgggtttggaaactttactatccaatgaaaatcaaccctcaaaacccaaaccaccaaataatcccaacatccctaccttacctcacaaggatacaaaagcaactcaacaagaacgcctgcttcagttgggcaaggctcgcgaagaatatcagacagggttacggctgcctaattctgcgaaagtgaagactttacccgctcaagaagcattttcggaaagatataacaataatcgagtcatcttatcggagaaaatagcagctaatcaacaagcatttctcagcaatcctcaaccttttcaaagcttcgatgactacgcggcgttgtttcccgttttgccgttaccaggtattgctaaaaccttccgcaacgatgatgtatttgcacggcagcgtctttctggctgcaatcccatggaactgaagaacgttctcaaactgggttacagtcttcgcgacaaaatggggataacggatgagatttttcaagctgtactgggcgcgacaagaggcagaaagccgattcataataatcagactctcaacagcgctattcgagaagggagtttatttgtcacagactatgcggtacttgatagcgttacaccgaaggaaacgcaatatttgtgcgcccccattgccctctattatgccgcaaggattcgcggcgattttcatttaattcccattgctatccagttgggacaggtaccaggagaaagtttactttgtacacctttagatggcgtagattggactttagccaaattaattacccagatggctgatttctccatcaatcaactgtaccgtcacttgggacaaactcatctagtaatggaaccaatcgccttagcaacagtacgcgaactagctgctcgccatcccgtcaacgtcctcttaaagcctcatgttgaatttacaatggcaattaatagccttggtgatcaggtgttgattaatccggggggagcagtagatgttatcttaccaggcactttggaaagctcactcaaactcaccgaaagaggggtatccgacttttgcaacaacttcagcaactttgcactcccgactaatttacgtcagcgcggtgttgataattcttcgattctgcaagattttccctatcgagacgacggcttgctcatctggaatgccttagaagaatatgtgagtcaatatatcggaatttactacaaatccaaccgagatatccgcgaggatttcgagctacaaaaatggttccaagctttacggaaacccgttagtgaaggtggttttggtatagtttcattaccagcaagcttgacgaaccgcaaccaattgatagatattttgacaatcattattttcaccgcaggtccgcaacactcagcgatcgcttggactcaatatcaatacatggcttttattccgaatatgcccggagcgctttatcagcctattcccacaaccaaaggaaaatttgcaaatgaaaatagcctcacgagtttcctaccgggagtcaaaccaagccttactcaagtccagtttatgtcgttagtcggtaccaagcgcgaccccaaggcgtttacagacttcggtacaaatagttttcaagaccctcgagccattagggttcttagagatttgcagaatcgcttagagtcagtagaaaaacggattaaaatacttaataaacgtcgccaagaatgctaccctgcttttctaccctctcgaatgtcgaatagtgtcagtggatag

SEQ ID NO: 216 - protein, 640 aa, Calothrix sp. NIES-4101
MRSPTPKQRRQELIDTYILSRRSMMMLMAVAATPGIEMLLFGGNKSSQASATGNFENCNPGLETLLSNENQPSKPKPPNNPNIPTLPHKDTKATQQERLLQLGKAREEYQTGLRLPNSAKVKTLPAQEAFSERYNNNRVILSEKIAANQQAFLSNPQPFQSFDDYAALFPVLPLPGIAKTFRNDDVFARQRLSGCNPMELKNVLKLGYSLRDKMGITDEIFQAVLGATRGRKPIHNNQTLNSAIREGSLFVTDYAVLDSVTPKETQYLCAPIALYYAARIRGDFHLIPIAIQLGQVPGESLLCTPLDGVDWTLAKLITQMADFSINQLYRHLGQTHLVMEPIALATVRELAARHPVNVLLKPHVEFTMAINSLGDQVLINPGGAVDVILPGTLESSLKLTERGVSDFCNNFSNFALPTNLRQRGVDNSSILQDFPYRDDGLLIWNALEEYVSQYIGIYYKSNRDIREDFELQKWFQALRKPVSEGGFGIVSLPASLTNRNQLIDILTIIIFTAGPQHSAIAWTQYQYMAFIPNMPGALYQPIPTTKGKFANENSLTSFLPGVKPSLTQVQFMSLVGTKRDPKAFTDFGTNSFQDPRAIRVLRDLQNRLESVEKRIKILNKRRQECYPAFLPSRMSNSVSG

SEQ ID NO: 217 - DNA, 1890 bp, Nodularia spumigena
  CDS (1)..(1890)
atgactacttcatcaccagataattcccgcagtctccccatcacccagaacttggagttagtgaggcaggaatatcaatataactatacccatattccacctattcctatggtgaatcagcttcctaatcaggaaaacttcactactagatggacttttttattagcccagcagttacgggagattttcattaatactctgatcactaaccgaggcgatcgcagttccaaatcggttcgtgatcaagtcaaaaggtttattttagaagccttgttcaagggggctataccagccaaagtaagtgtgattgcgagacttttccaaattattccccagtttctcattcaaggaatatctaaagattttcacgaactagatgatctgtttttttcccttttcaaaaccaacggactgttaatattcagagattctctgaatcgaattacagcccttttagataaaggccatcccacaggtcatgtgaatagtttaaaggactaccaaaagttatttaccacaattgaattaccagcgatcgccaaaactttcgatcaagatcaagtctttgcctatatgcaagtcgccggctacaatcccctagtaatcaagcgggtaaaaagtccaggcgctaacttcccagttgaagatacacattaccaagcagtaatggggagtgatgattcattagcagccgcaggacaagaaggacggctatacctagcagactatcaaattttagacggtgctatcaacggtatatatctaaattaccaaaagtatgcctatgctcccctagcgctgtttgccatccccaaaaactcagacccaaatcgtctactgcgccccatagctattcaatgtggtcaaactcctggagccgattatcccatcattacccccaattccggcaaatacgcctggctatttgccaaaaccattgtccacatagcagatggcaactttcatgaagctgtcagtcacctagcccgaacgcacctattcgttggtgtctttgtcatcgccacccatcggcaattgtcccccagccatcccctcagcctcctactgcgtccccattttgaaggcactttagcgattaacaatgccgcccaagaagttttgattgctcctggcggcggagttgatatattgctttcatcgacaattgataactctcggattttagcagtgcgcggtttgcaaagctatagtttcaatgaagctatgttgccaaaccaactcaaacaacgaggtgttgatgatcctgaactactgcctgtttatccttaccgggatgatgcattactaatttggaacgccattcatcaatgggtttccgactacctgagcctttactaccctacagataaagatattcaaaatgatactgctttgcaagcatgggcagccgaagccaaagctgacaatggtggacgtgtacctgattttggtgaaaatggaggtattcagacactagactacctagttgatgctgctaccctgattatttttacagccagcgcccaacacgctgcggttaacttcccccaaaaagatttgatgagttatgcccctgcttttcccttagcaggatatgtatccgcctccatcaacggagaagttagtgagcaagactacctgaatttactcccacctttggagcaagcgcaacagcaatttaacttgctcactttactagggtctatatattacaaccagcttggtgaatatccaaaatcacactttgctaaccccaaggtacaaatcttgttacagaagttccaaagccgtcttcagcaaattgaaattacgatcaatcagcgcaatttgcaccgcccaacttacgaatatctacttccttctaaaatccctcagagcattaatatttga

SEQ ID NO: 218 - protein, 629 aa, Nodularia spumigena
MTTSSPDNSRSLPITQNLELVRQEYQYNYTHIPPIPMVNQLPNQENFTTRWTFLLAQQLREIFINTLITNRGDRSSKSVRDQVKRFILEALFKGAIPAKVSVIARLFQIIPQFLIQGISKDFHELDDLFFSLFKTNGLLIFRDSLNRITALLDKGHPTGHVNSLKDYQKLFTTIELPAIAKTFDQDQVFAYMQVAGYNPLVIKRVKSPGANFPVEDTHYQAVMGSDDSLAAAGQEGRLYLADYQILDGAINGIYLNYQKYAYAPLALFAIPKNSDPNRLLRPIAIQCGQTPGADYPIITPNSGKYAWLFAKTIVHIADGNFHEAVSHLARTHLFVGVFVIATHRQLSPSHPLSLLLRPHFEGTLAINNAAQEVLIAPGGGVDILLSSTIDNSRILAVRGLQSYSFNEAMLPNQLKQRGVDDPELLPVYPYRDDALLIWNAIHQWVSDYLSLYYPTDKDIQNDTALQAWAAEAKADNGGRVPDFGENGGIQTLDYLVDAATLIIFTASAQHAAVNFPQKDLMSYAPAFPLAGYVSASINGEVSEQDYLNLLPPLEQAQQQFNLLTLLGSIYYNQLGEYPKSHFANPKVQILLQKFQSRLQQIEITINQRNLHRPTYEYLLPSKIPQSINI

SEQ ID NO: 219 - DNA, 1890 bp, Nodularia spumigena
  CDS (1)..(1890)
atgactacttcatcaccagataattcccgcagtctccccatcacccagaacttggagttagtgaggcaggaatatcaatataactatacccatattccacctattcctatggtgaatcagcttcctaatcaggaaaacttcactactagatggacttttttattagcccagcagttacgggagattttcattaatactctgatcactaaccgaggcgatcgcagttccaaatcggttcgtgatcaagtcaaaaggtttattttagaagccttgttcaagggggctataccagccaaagtaagtgtgattgcgagacttttccaaattattccccagtttctcattcaaggaatatctaaagattttcacgaactagatgatctgtttttttcccttttcaaaaccaacggactgttaatattcagagattctctgaatcgaattacagcccttttagataaaggccatcccacaggtcatgtgaatagtttaaaggactaccaaaagttatttaccacaattgaattaccagcgatcgccaaaactttcgatcaagatcaagtctttgcctatatgcaagtcgccggctacaatcccctagtaatcaagcgggtaaaaagtccaggcgctaacttcccagttgaagatacacattaccaagcagtaatggggagtgatgattcattagcagccgcaggacaagaaggacggctatacctagcagactatcaaattttagacggtgctatcaacggtatatatctaaattaccaaaagtatgcctatgctcccctagcgctgtttgccatccccaaaaactcagacccaaatcgtctactgcgccccatagctattcaatgtggtcaaactcctggagccgattatcccatcattacccccaattccggcaaatacgcctggctatttgccaaaaccattgtccacatagcagatggcaactttcatgaagctgtcagtcacctagcccgaacgcacctattcgttggtgtctttgtcatcgccacccatcggcaattgtcccccagccatcccctcagcctcctactgcgtccccattttgaaggcactttagcgattaacaatgccgcccaagaagttttgattgctcctggcggcggagttgatatattgctttcatcgacaattgataactctcggattttagcagtgcgcggtttgcaaagctatagtttcaatgaagctatgttgccaaaccaactcaaacaacgaggtgttgatgatcctgaactactgcctgtttatccttaccgggatgatgcattactaatttggaacgccattcatcaatgggtttccgactacctgagcctttactaccctacagataaagatattcaaaatgatactgctttgcaagcatgggcagccgaagccaaagctgacaatggtggacgtgtacctgattttggtgaaaatggaggtattcagacactagactacctagttgatgctgctaccctgattatttttacagccagcgcccaacacgctgcggttaacttcccccaaaaagatttgatgagttatgcccctgcttttcccttagcaggatatgtatccgcctccatcaacggagaagttagtgagcaagactacctgaatttactcccacctttggagcaagcgcaacagcaatttaacttgctcagtttactagggtctatatattacaaccagcttggtgaatatccaaaatcacactttgctaaccccaaggtacaaatcttgttacagaagttccaaagccgtcttcagcaaattgaaattacgatcaatcagcgcaatttgcaccgcccaacttacgaatatctacttccttctaaaatccctcagagcattaatatttga

SEQ ID NO: 220 - protein, 629 aa, Nodularia spumigena
MTTSSPDNSRSLPITQNLELVRQEYQYNYTHIPPIPMVNQLPNQENFTTRWTFLLAQQLREIFINTLITNRGDRSSKSVRDQVKRFILEALFKGAIPAKVSVIARLFQIIPQFLIQGISKDFHELDDLFFSLFKTNGLLIFRDSLNRITALLDKGHPTGHVNSLKDYQKLFTTIELPAIAKTFDQDQVFAYMQVAGYNPLVIKRVKSPGANFPVEDTHYQAVMGSDDSLAAAGQEGRLYLADYQILDGAINGIYLNYQKYAYAPLALFAIPKNSDPNRLLRPIAIQCGQTPGADYPIITPNSGKYAWLFAKTIVHIADGNFHEAVSHLARTHLFVGVFVIATHRQLSPSHPLSLLLRPHFEGTLAINNAAQEVLIAPGGGVDILLSSTIDNSRILAVRGLQSYSFNEAMLPNQLKQRGVDDPELLPVYPYRDDALLIWNAIHQWVSDYLSLYYPTDKDIQNDTALQAWAAEAKADNGGRVPDFGENGGIQTLDYLVDAATLIIFTASAQHAAVNFPQKDLMSYAPAFPLAGYVSASINGEVSEQDYLNLLPPLEQAQQQFNLLSLLGSIYYNQLGEYPKSHFANPKVQILLQKFQSRLQQIEITINQRNLHRPTYEYLLPSKIPQSINI

SEQ ID NO: 221 - DNA, 1944 bp, Acaryochloris sp. CCMEE 5410
  CDS (1)..(1944)
atgacgccacaatatgaatatcgatacgatgccctgaaagacgtttcccctgaattgaaatatccaatggccaaggaggtgtttccagcagaccaatctttgacaaaatggccctggactcgagatctcgtttccgttgtcctcagaattattgccaatcaggccatgcaggatatatccgtccgtagaggatcagcctgtcgtctgattacgtttattcgcttatatcgaattctagaaaatcccctctatcagtcaggtctggagaggcttttcaatgctgtcaataatcttgtacggggtctctccaatatttttggcaacagagcccagtctcaaaatatcaaacatgatgtaaaggaggagcaacatcctgacaaagtctccgcccgcatttcagcaatggtcaaggatatccaagaaacggctgaatcgagagaggctaaagagcaaccgtccttagcagactatcgcgatctctttcagatcatttacttaccagacattagcaatcatttcctagaagatcgtgcctttgccgctcaacgggttgccggagctaaccccctcgtgattaaccgaatttctgaactcccagaccatttccaagtcactgaccaacagtttaaatcggtgatgggagatagtgagtccctccaagcagccttgaatgatggccgagtgtatctggtagactatcaaattcttgaagaaattgatgcgggtacagtcgaggtgaaggatcgtgaaattctgaagtatcgctatgcaccgttggccttatttgcgatcgcatccgggaattgtcccggtcgcctcctccagccgattgccattcaatgccatcaagaagcaggcagcccgatatttacaccacccagtctagaagccgataaagaggagcggcttgcttggagaatggccaagaccgtcgttcaaatcgccgacggtaactaccatgaattgatttctcatttagggcggactcatctctggattgagcccattgctttaggcacttaccgacgcctaggaacagagcatccactgggtaaattgctcctaccccacttcgaaggcaccttatttatcaacaatgcagcagccaatagcttaattgccccgggtggcaccgtagacaaaatcttgtttggcaccttaaagtcatccgttcagctcagcgtcaaaggcgctaagggttaccccttttctttcaatgattccatgctcccccaaacctttgcatcccgaggcgtggacgacctacaaaagctaccggactacccctatcgagatgatgcattactgatttggcatgccattcacgattgggttgaggcctatcttcagatctactacaaagatgatgatgcagttctcaaggatgaaaccctccaggattggttaaccgagctaagagctgaagatgggggccagatgactgaaatcggtgaatcgactccagaagaacccgagcctaaaattcgcaccttggattatctagtaaacgcgacaacgctgattattttcacttgtagtgctcaacatgcatcggtcaattttccccaagcatcgttgatgacgtttgtccccaatatgcccctagccgggttcaatgaaggcccgacagcagagaaagccagtgaagcagactatttctctttactaccacccctgagtttggccgaacaacagttggatctagggtataccttgggttcggtctactatactcagctcggatattacaaagccaatgatgtagatttaggtgatattaacaaccatacctacttcaacgacctccaagttaaacaggctctcctaagcttccaacaaagattagaagagattgagttgatcattcaagaccggaacgaaacccgacccacatattacgacatcttgctcccgtccaagattccccaaagtaccaacatttaa

SEQ ID NO: 222 - protein, 647 aa, Acaryochloris sp. CCMEE 5410
MTPQYEYRYDALKDVSPELKYPMAKEVFPADQSLTKWPWTRDLVSVVLRIIANQAMQDISVRRGSACRLITFIRLYRILENPLYQSGLERLFNAVNNLVRGLSNIFGNRAQSQNIKHDVKEEQHPDKVSARISAMVKDIQETAESREAKEQPSLADYRDLFQIIYLPDISNHFLEDRAFAAQRVAGANPLVINRISELPDHFQVTDQQFKSVMGDSESLQAALNDGRVYLVDYQILEEIDAGTVEVKDREILKYRYAPLALFAIASGNCPGRLLQPIAIQCHQEAGSPIFTPPSLEADKEERLAWRMAKTVVQIADGNYHELISHLGRTHLWIEPIALGTYRRLGTEHPLGKLLLPHFEGTLFINNAAANSLIAPGGTVDKILFGTLKSSVQLSVKGAKGYPFSFNDSMLPQTFASRGVDDLQKLPDYPYRDDALLIWHAIHDWVEAYLQIYYKDDDAVLKDETLQDWLTELRAEDGGQMTEIGESTPEEPEPKIRTLDYLVNATTLIIFTCSAQHASVNFPQASLMTFVPNMPLAGFNEGPTAEKASEADYFSLLPPLSLAEQQLDLGYTLGSVYYTQLGYYKANDVDLGDINNHTYFNDLQVKQALLSFQQRLEEIELIIQDRNETRPTYYDILLPSKIPQSTNI

SEQ ID NO: 223 - DNA, 1878 bp, Nostoc sp. CENA543
  CDS (1)..(1878)
atgacaaatagtctaactagtgccacaactaattccaatctagaatcagctagagagcaatataagtataactacagctacattccgccgatcgcaatggtggatgaactaccagatggggaagatttctcccgtcaatggttgctgttgctggctaaagagttaaaagtaatttttgtgaatattttgattaccaatagaggtaatcgaggttcgcaaaagattcgtgatgatgtcagaaattttattctagaagttattctcaaaggtgctataccagctaacatcagtgtaattgctcgatttatgcaaattgtcccccaattgttaattcgggggttttctacggattttcacgaactggacgatctgttattttcgctaattaaagaaagtgggcttttaattctgagtgattccttccaacgaattactaaactcctcgacaaaggaaaacccacaggccatgtgagtagtttggcggactatcaaaagttgtttcccgtaattcccccgccaaagattgctaaaactttccaaaatgatgctgaatttgcctatatgcgggttgctggctacaatccggtgatgattcagcgagttagtgagttagatgaacgcttccccgttaccgatgcacaatatcaagccgtcatgggtagtgatgattcccttgccctggctggtcaagaaggtagactttatctagctgactatggcattttcaacggtggactcaatggttcatgtcccagctatcaaaagtatctctatgcacctttagcactgtttgcagttcctccaggctcaaaccccaatcgtctattacagccagtggcgattcaatgcggtcaaaaccccaaggaaaatcccatcatcacgccaaaatctagtgaatatgcttggttaattgctaaagccatcgtccagattgctgatgctaactttcacgaaccaattacccaccttgccagaacacatttattagcggggatttttgcgatcgctacccatcgtcaactccccaattctcatcccctctacgtgcttctcacgccccattttgaaggcactttagccattaatgatgccgcccaacgcgccctaattgcacctttgggtggggtagatattttgctttcatctactattgataactctcgtgtcttaactgtgctaggtctgcaaagctatggctttaatcatgccatgttgccgaaacaattccagcaacggggtgtagatgatgccaatcttttacctgtatatccttatcgggatgatggtttattactgtgggatgcaattcatcaatgggttgccgattacattcaaatttactaccacacagaccaagaaattcaagccgacgcatatattcaagcttgggcaaaagaggtacaggcttatgatggtggtcgcctcacagagtttggtgaagatggcaaaattcagaccagggaatatttaattgatgccgtcaccttaattatttttaccgccagcgtccaacacgccgccgtcaactttccccaaaaagatgtcatgggttatactccagccgtacccttagcaggttatttacccgcctccattcttcaaggggaagttacagaaaaagactatctcaactttttaccaccattagaccaagcccaacagcaatataatctactcgccttactaggttctgtttattacaacagactaggggaatacccgccccaacattttgctgatcctaaagtcgaacccttattgcgatcgttccaaaagaacttacaagagatcgaaaccatcatccaaaagcgtaacagcgatcgcccaccctacgaatatctcctaccctcaaaaattcctcaaagcatcaatatctaa

SEQ ID NO: 224 - protein, 625 aa, Nostoc sp. CENA543
MTNSLTSATTNSNLESAREQYKYNYSYIPPIAMVDELPDGEDFSRQWLLLLAKELKVIFVNILITNRGNRGSQKIRDDVRNFILEVILKGAIPANISVIARFMQIVPQLLIRGFSTDFHELDDLLFSLIKESGLLILSDSFQRITKLLDKGKPTGHVSSLADYQKLFPVIPPPKIAKTFQNDAEFAYMRVAGYNPVMIQRVSELDERFPVTDAQYQAVMGSDDSLALAGQEGRLYLADYGIFNGGLNGSCPSYQKYLYAPLALFAVPPGSNPNRLLQPVAIQCGQNPKENPIITPKSSEYAWLIAKAIVQIADANFHEPITHLARTHLLAGIFAIATHRQLPNSHPLYVLLTPHFEGTLAINDAAQRALIAPLGGVDILLSSTIDNSRVLTVLGLQSYGFNHAMLPKQFQQRGVDDANLLPVYPYRDDGLLLWDAIHQWVADYIQIYYHTDQEIQADAYIQAWAKEVQAYDGGRLTEFGEDGKIQTREYLIDAVTLIIFTASVQHAAVNFPQKDVMGYTPAVPLAGYLPASILQGEVTEKDYLNFLPPLDQAQQQYNLLALLGSVYYNRLGEYPPQHFADPKVEPLLRSFQKNLQEIETIIQKRNSDRPPYEYLLPSKIPQSINI

SEQ ID NO: 225 - DNA, 1884 bp, Limnothrix rosea
  CDS (1)..(1884)
atgaccgcaacatcaggctcccaaaatctaggcttaatcgaaaagcaagaaaagtataagtataactatagtcacattcctccagtggcaatggtcgataccttgccggaaagcgaaaaatggtcaataccttggaagttgatggtggcgaaggtgggttatcagcttttggttaataaaataattgtgacttatggtgatcaagggaaggctggtgcagcgaatgatgtacgggcttttttgattgctaggttaaaggaaacttttggggaacagaaagggttgtccaaagtgcgtgtcttgctgcaaggtgcgaggtttctgcctcgaattatttggggtgaaattacgacggatgttgtggatgttgaagaggtgatgcgggatgctattaaaactgttagtagagattttctagaggattttgctgcaaatgtgatggagcaacttaccgttgacggtaaggatggtcgttgtctatcgagtacagattttgagaggctttttgccacgattgatttaccggagattgcttatgagtatcaaacggatgaaagttttgcttatatgagggtggcgggacctaatgcggttatgctcgaaaaaatcacggaacctgatcctcgttttcctgtgacggaggctcattatcaagcggtgatgggagagggggattctcttgctgcggcaagggcggagggtcgattatttttgtgtgattatgagattttggatggtgcggttaatggttcttttccgacggatcagaaatatctttatgcgccgttagcgttgtttgctgtaccaaaggcagatgctgggaaacgtgatttgaggcctgttgcgattcagttgggtcaaaaaccgaaggagtatccgattctcacgccgaagtctaatcggtatgcttggctctgtgcgaaaacggcggtacaggttgcggatgcgaatttccatgaggcggttactcatttagggcggactcatttgtttatggggccgtttgtgatcgccacccatagacaattgccagaaaatcatcctttgtttaaattactaacgccccattttttagggatgttggcgatcaatgattctgcgcaggcgaaattgatttacaaggggggtggtgttgataaaattttggcgacaactattgataatgcccgtttgtttgcggtgctgggtgtgcaaacctatggttttaatcgtgctatgttgccggatcaattggctgcgcgcggtgttgatgatacggaggcattaccggtttatccctatcgtgatgatgctttattgatttgggaggcgatttataactgggttaaggcttacttgaagacttattatccgggcgatagtgctgtgcagcgtgatcaggcgctacaagcttgggcaaaggaactcatttcctataagggtgggcgagtggtggactttggtgaagatggtgatatcaaaacgttgtcgtacctgatcgatgcagtgacgctcattatttttacggtgagtgcccaacatgcggcggtaaattttccgcagaagggtttgatgagttttgcgccgggtatgccgactgcgggctatgctccccttgataatctgggtgatcagacggcagaacaggattatcttgatttgctgccgccaatttctcaggctcaggagcaattaaaactgtgtcatttacttgggtctgttcacttcacgcagttagggcagtatgacaaaaagcatcttggtgacccgaaaattcaaaagccgctgcggcaatttcaagggcgactcgaggaaattgagatgattatccacaagcgtaatggcgatcgcccaacctatgaatatttactccctagtcttattccccagagtatcaatatctaa

SEQ ID NO: 226 - protein, 627 aa, Limnothrix rosea
MTATSGSQNLGLIEKQEKYKYNYSHIPPVAMVDTLPESEKWSIPWKLMVAKVGYQLLVNKIIVTYGDQGKAGAANDVRAFLIARLKETFGEQKGLSKVRVLLQGARFLPRIIWGEITTDVVDVEEVMRDAIKTVSRDFLEDFAANVMEQLTVDGKDGRCLSSTDFERLFATIDLPEIAYEYQTDESFAYMRVAGPNAVMLEKITEPDPRFPVTEAHYQAVMGEGDSLAAARAEGRLFLCDYEILDGAVNGSFPTDQKYLYAPLALFAVPKADAGKRDLRPVAIQLGQKPKEYPILTPKSNRYAWLCAKTAVQVADANFHEAVTHLGRTHLFMGPFVIATHRQLPENHPLFKLLTPHFLGMLAINDSAQAKLIYKGGGVDKILATTIDNARLFAVLGVQTYGFNRAMLPDQLAARGVDDTEALPVYPYRDDALLIWEAIYNWVKAYLKTYYPGDSAVQRDQALQAWAKELISYKGGRVVDFGEDGDIKTLSYLIDAVTLIIFTVSAQHAAVNFPQKGLMSFAPGMPTAGYAPLDNLGDQTAEQDYLDLLPPISQAQEQLKLCHLLGSVHFTQLGQYDKKHLGDPKIQKPLRQFQGRLEEIEMIIHKRNGDRPTYEYLLPSLIPQSINI

SEQ ID NO: 227 - DNA, 1869 bp, Tolypothrix bouteillei
  CDS (1)..(1869)
atgcgttcgcgtagcggctgctttgcagcatcgccaaaccgacaacaaagacaccaacaattaatcgagcagtacgttttctcgcgccgtaccatgctagcgctccttggtttcatttgtgctccaggcttggaacattttatagtaagtgacactcaaccaagagaacccacgcttcctgccaatcctcaaatcccaactttacctcaaaaaaattcattggcatcccaaaaagaacgccaacagcagcttgagattgcacgctctaaataccagctaacacctcgactgccaaactctgttagggtatcaactttaccgatcgaagaggcttttgatgggggctatagcagtaatcgggcaagcataacccggaaaattacagaaaatcaacaagcatttttccaaaatcccaaaccttttctcgcattagaagactacacaaatgtttttcaagttttacccgtaccggatattgctaaaacctttcgcaaggatgcgatatttgcagggcaacggctgtggggtcccaatcccatggaacttaccaacgttctagcactcaattacgatcttcaagaaaaactgggaataacaaatgagatttttcaaaccgttttgggtgctgctagaggaacggcatatgttagcgaaactcttgaaagtgctactaaaaatggcggtctgtttgtaacggattatgcaatccttgcgactgatggcattacctcaaaaacaaagcgatatctcattgctcctatcgctctttattacgccgatcgcgaccgtggtaattggcgtttaattcccattgccattcaactcggacaagttcctcaagaaagtttgctttgtactcccttggatggagtggattggactctagccaagctcatcgctcaaatggctgatttttccgttcatgaattggtccgtcacttgggtcaaacccatcttgctctagaacccatcgcactggcaactgtacgcgaactccctgcccttcatcccgtacacgtcctattaaaaccccattttgagttcacaatggcaatcaatgcttttggcgatcgagtgttgattaatccagggggatacgtagatgtcattctaggaggtactttagaaagctccctcaaccttgtaaatcttggtgtctcggaaatgttcgataacttcagcaactttgctttgccgaacaatttacaaaggcgcggtgttggcgatcgctctttattaaaagattttccctatcgagatgacggagtgctggtttgggatgctctatccgagtatgtcagtcggtatgtaggaatttactacagatcttctaaagatattcgagaggatttcgagttacaaaattggttaaaagctttacggacacctgttagtgatggaggttttggtgtcacttctttaccatcctacctaaaagaccgcgaccagttaattgacctgctaacacaaattatttttacagcaggtccgcaacactcagccattgcctggactcaatatcagtatatgtcttttgtccctaatatgcctggagctatttatcagcctgttcctattaccaagggaacaattgaagatgagaagagtttaacaagttttcttcctggtatagaaccaacttttgcacaagttaacgtcatatcgggaattggtgtcaaacttgatgtcaaagcatttacagattttggtgtcaatagttttcaagatccgcgagctattgctgttcttaaaggcttgcaaaatcgtttggaggttgtagaaaaacagatcgaacaacgaaataaacgccgagaggaatgctaccctggctttttaccttctcgtatggctaacagtaccagtggttga

SEQ ID NO: 228 - protein, 622 aa, Tolypothrix bouteillei
MRSRSGCFAASPNRQQRHQQLIEQYVFSRRTMLALLGFICAPGLEHFIVSDTQPREPTLPANPQIPTLPQKNSLASQKERQQQLEIARSKYQLTPRLPNSVRVSTLPIEEAFDGGYSSNRASITRKITENQQAFFQNPKPFLALEDYTNVFQVLPVPDIAKTFRKDAIFAGQRLWGPNPMELTNVLALNYDLQEKLGITNEIFQTVLGAARGTAYVSETLESATKNGGLFVTDYAILATDGITSKTKRYLIAPIALYYADRDRGNWRLIPIAIQLGQVPQESLLCTPLDGVDWTLAKLIAQMADFSVHELVRHLGQTHLALEPIALATVRELPALHPVHVLLKPHFEFTMAINAFGDRVLINPGGYVDVILGGTLESSLNLVNLGVSEMFDNFSNFALPNNLQRRGVGDRSLLKDFPYRDDGVLVWDALSEYVSRYVGIYYRSSKDIREDFELQNWLKALRTPVSDGGFGVTSLPSYLKDRDQLIDLLTQIIFTAGPQHSAIAWTQYQYMSFVPNMPGAIYQPVPITKGTIEDEKSLTSFLPGIEPTFAQVNVISGIGVKLDVKAFTDFGVNSFQDPRAIAVLKGLQNRLEVVEKQIEQRNKRREECYPGFLPSRMANSTSG

SEQ ID NO: 229 - DNA, 2013 bp, Acaryochloris marina
  CDS (1)..(2013)
atgacgcatcagtactccctcactggcctgccgacccaaatcacacctgtagaaattcaacaggacaaacatcaacccactctggcccccactcgtcctaatccgacccagccggagcctatccccgcagcgctaaaagcagctcgacgcaaatatcaatacaactatagtcacattgcccctgtggccatggtggatcgcttacccaaagaggaactcccctctagggcttggtggtcaaagttgatccgtaccatgttcaagattctctcgaatgccattgttggcgcccataatcaccaccatgagcatgaagcagagcagcatgcttctcgcctcattcgcaaaaccttggtggatatcttgagacaacgccccgaggtgcggtggcgtctcatctggcatctgctgaaaacagcgccaacgactttgcttaacggtttacggttgtcgttttctgatgccgaaagcttgctgcacagtttagccgcccatttagagcatgatctattacggattctgcacttgaacttaaaagaacatctagcccatgaatgtggacaagatcgccctacctcaatagcagactttaatcagcagtttgcaacgattccgttaccggagtgtgccgaatactttcaagaagatgagttttttgcttacttgcgagtagccggtcctaatcctgttttgctgcaacaagtccgccatttatcgggagacatcctctgctctcatttcccagttaccaatcagcattatcagaccgtaatgggagaagacgattctctgcaaatagcaatcaccgaaggccgtctatacatcgccgattatgctattttggctggtgcgatcaatggtaactaccccgatcagcaaaaatatatttcggctcccatcgccctttttgccgttccctcagctgatgccccctgccgaaatctccagcccatcgctattcaatgccgccaatctccagggcctgaaacaccgattctgacgccgcctacggatcagaatccagaccaaaaacaggcctgggacatggcgaagacctgcgtgcaagttgcagacagcaattaccatgaggccgtcacccatttgggtcgaacccatctgtttattagcccgtttgtaattgccacccatcgccaactactgccgtctcatcccgtgagtgtcctgcttcggcctcactttgaaggcaccttaagtatcaacaacggtgctcaaagcatgttaatggcgccagaaggtggagtggatacggtcttggctgccactatcgactgtgccagggtcttagccgtaaagggagtacaaagctattcctttaatcaggccatgctgccccaacaattgcggcaactgggtttggataatgcagaggcgcttcccatccacccctatcgagacgatgcattgctgatttggcaggccatcgaaacttgggtcactgattatgtgagcttgtactacccaacagatgactccgtgcaaacagatgcggcccttcaggcttgggcgcaggagctacaggctgaagagggtggccgagtcccagattttggtgaggatggacaattgcgaacccaggcctacttgattcaagccctcacgctgatcatctttaccgcgagtgcccaacatgccgctgtgaattttccccagggcgacatcatggtctataccccagggatgccattagcaggctaccagcccgctcccaactcgacagctatgtcttcccaggatcggctcaaccaactgccctccttacaccaggccttaaatcagctggagttaacgtatttgctcgggcagatttaccatacgcaactcggtcaatacgaaaagtcttggttctctgatcagcgagtgcaagctccgctgcatcggtttcaagccaatttactggatatcgaaactgcgatcgcagaacgaaaccgccatcgcccctacccttaccgctacctacagccgtccaacattccccagagcatcaatatctaa

SEQ ID NO: 230 - protein, 670 aa, Acaryochloris marina
MTHQYSLTGLPTQITPVEIQQDKHQPTLAPTRPNPTQPEPIPAALKAARRKYQYNYSHIAPVAMVDRLPKEELPSRAWWSKLIRTMFKILSNAIVGAHNHHHEHEAEQHASRLIRKTLVDILRQRPEVRWRLIWHLLKTAPTTLLNGLRLSFSDAESLLHSLAAHLEHDLLRILHLNLKEHLAHECGQDRPTSIADFNQQFATIPLPECAEYFQEDEFFAYLRVAGPNPVLLQQVRHLSGDILCSHFPVTNQHYQTVMGEDDSLQIAITEGRLYIADYAILAGAINGNYPDQQKYISAPIALFAVPSADAPCRNLQPIAIQCRQSPGPETPILTPPTDQNPDQKQAWDMAKTCVQVADSNYHEAVTHLGRTHLFISPFVIATHRQLLPSHPVSVLLRPHFEGTLSINNGAQSMLMAPEGGVDTVLAATIDCARVLAVKGVQSYSFNQAMLPQQLRQLGLDNAEALPIHPYRDDALLIWQAIETWVTDYVSLYYPTDDSVQTDAALQAWAQELQAEEGGRVPDFGEDGQLRTQAYLIQALTLIIFTASAQHAAVNFPQGDIMVYTPGMPLAGYQPAPNSTAMSSQDRLNQLPSLHQALNQLELTYLLGQIYHTQLGQYEKSWFSDQRVQAPLHRFQANLLDIETAIAERNRHRPYPYRYLQPSNIPQSINI

SEQ ID NO: 231 - DNA, 1869 bp, Tolypothrix bouteillei
  CDS (1)..(1869)
atgcgttcgcgtagcggctgctttgcagcatcgccaaaccgacaacaaagacaccaacaattaatcgagcagtacgttttctcgcgccgtaccatgctagcgctccttggtttcgtttgtgctccaggcttggaacatttcatagtgggtgacactcaaccaagagaacccaagcttcctgccaatcctcaaatcccaactttacctcaaaaaaattcattggcatcccaaaaagaacgccaacagcagcttgagattgcacgctctgaataccagctaacatctcgattgccaaactctgttagggtgtcaactttaccaatcaaagaggcttttgatgggggctatagcaataatcgggcaagcataacccagaaaattacagaaaatcaacaagcatttttccaaaatcccaaaccttttctcgcattagaagactacacgaatgtttttcaagttttacccgtaccggatattgccaaaacctttcgcaaggatgtgatatttgcagggcaacggctgtggggtcccaatcccatggaacttaccaacgttttagcactcaattacgatcttcaagaaaaactggggataacaaatgagatttttcaaaccgttctaggtgctgctagaggaacggcatacgttagcgaaactcttgaaagtgctaccaaaaatggtggtctgtttgtaactgattatgcaatccttgcgactgatggcattacttcaaaaacaaaccgatatctcattgctcctatcgctctttattacgccgatcgcaaccgtggtaattggcgtttaattcccattgccattcaactcgggcaagttcctcaagaaagtttgctttgtactcccttggatggagtagattggactctagccaagctcatcgctcaaatggctgatttttccgttcatgaattggtccgtcatctgggtcaaacccatcttgctctagaacccattgcactggcgactgtacgcgaactccctgcccttcatccagtgaacgtcctattaaaaccccattttgagttcacaatggccatcaatgcttttggcgatcgggtgttgattaacccagggggatacgtagatgtcattctgggaggtactttagaaagctccctcaagctgactaaccttggtgtctcggagatgttcgataacttcagcaactttgctctgccgaacaatttacaaaggcgcggtgttggcgatcgctctttattaaaagattttccctatcgagatgacggagtgttggtttgggatgctctatccgagtatgtcagtcggtacgtaggaatttactacaaatcttctaaagatattcgagaggatttcgagttacaaaattggttaaaagctttacggacacctgttagtgatggaggttttggtgtcacttctttaccatcctacctacaagaccgcgaccagttaattgacctgctaacacaaattatttttacagcaggtccgcaacactcagccattgcttggactcaatatcagtatatgtcttttgttcctaatatgcctggagctatttatcagcctgttcctattaccaagggaacaattgaagatgagaagagtttgacaagttttcttcctggtatagaaccaacttttgcacaagttaacgtcatatcgggaattggtgtcaaacttgatatcaaagcatttacagatttcggtgtcaatagttttcaagatccgcgagctattgctgttcttaaaggcttgcaaaatcgtttggatgttgtagaaaaacagatcgaacaacgcaataaacgccgagaggaatgctaccctggctttttaccttctcgtatggctaacagtaccagtggttga

SEQ ID NO: 232 - protein, 622 aa, Tolypothrix bouteillei
MRSRSGCFAASPNRQQRHQQLIEQYVFSRRTMLALLGFVCAPGLEHFIVGDTQPREPKLPANPQIPTLPQKNSLASQKERQQQLEIARSEYQLTSRLPNSVRVSTLPIKEAFDGGYSNNRASITQKITENQQAFFQNPKPFLALEDYTNVFQVLPVPDIAKTFRKDVIFAGQRLWGPNPMELTNVLALNYDLQEKLGITNEIFQTVLGAARGTAYVSETLESATKNGGLFVTDYAILATDGITSKTNRYLIAPIALYYADRNRGNWRLIPIAIQLGQVPQESLLCTPLDGVDWTLAKLIAQMADFSVHELVRHLGQTHLALEPIALATVRELPALHPVNVLLKPHFEFTMAINAFGDRVLINPGGYVDVILGGTLESSLKLTNLGVSEMFDNFSNFALPNNLQRRGVGDRSLLKDFPYRDDGVLVWDALSEYVSRYVGIYYKSSKDIREDFELQNWLKALRTPVSDGGFGVTSLPSYLQDRDQLIDLLTQIIFTAGPQHSAIAWTQYQYMSFVPNMPGAIYQPVPITKGTIEDEKSLTSFLPGIEPTFAQVNVISGIGVKLDIKAFTDFGVNSFQDPRAIAVLKGLQNRLDVVEKQIEQRNKRREECYPGFLPSRMANSTSG

SEQ ID NO: 233 - DNA, 1887 bp, Calothrix parasitica
  CDS (1)..(1887)
atgactgatttatcgcaaaataattcgacatcagttgataaattaaaacttgctaggcaagaataccagtacagctatatccatattccacctattgctatggtagataaacttcctagtaacgagaatttctctactggttggctgcgtttattagctagagaattaaaagttgtttttatcaataccctaattgcaaatcgaggaaatcgcggttcggaaaatgttcgcgacgatgtgagattatttttcctggaagtattagcgaaaggagcattaccctttaatttaggtgttactgctagagttttacaaattattcctaatctattacttaaaggaacatcaaaagattttagcgaaatcgatgatttattcttttctatacttaaggaaagcggactgtcaatttttcaagattctttgagtcgagttaaaagtcttttgtatgaaaaacgtccgacgggacatgtaagcagcttgaatgattatcaaaaacttttccctgaaatggaaatacccaagatagctgataatttctctacagacgaacaatttgcttatatgcgggtagctggatataacccggtaatgattgagcgagtgaataaattgggcgatcgctttcctgttaccgaagctcaatatcaggaagtcatgggagatgattctttaacagcagcgggtgaggaaggaagactttatttagctgattatggaattttagaaggtgctgttaacggtacttttccttcacagcaaaagtatatctatgctccgctagcactatttgcaattcctaaaaattccgagaatgacgaatcgagtttaatgcgtccggttgcgattcagtgcggtcaaaacccccagaataatcctatttgtacgccaaaatcagacaaatatgcttggctgtttgcaaaaactattgttcaaatcgcagatgctaactaccacgaagctgtaactcatttaggacgtactcatttgcttgtaggtccctttgttgttgcaactcatcgtcagttaccggatagtcatccgcttaatatattattgcgtcctcattttgaagggactttagcaataaacaatgcagcccaaagtagtttgattgctgctggtgggggtgtggataaattacttgcatcgactattgataattcccgtgttttggcagcagttggtttacaaagctatgggttcaatgaagcaatgttacccaagcaattagaaaaacgcggggttaacgatacacaaaagctacctatttacccataccgcgatgatgctctattaatttggaatgctatacatacatgggttgcagattatctaagcatttattataaggacgataccagcattcaaaatgatacctatctccaaaattgggctattgaagcaggggcttacgatggtggacgcgttcctgattttggtcaagaaaatgggctgattcaaaccttggactatctaattgatgctactacactgattatttttactgctagcgctcaacatgctgcggttaatttcccccagggagacatgatgatctacgcggccgcagtacctttagctggttatcaacctgcttcaattctcgaaggaaaagttactcaggaagactacttaaatttacttccacctctagagcaagcacaagaacaattgaatttagtctatttattaggttctatttactataaaactttgggtgattactcagataattacttcaaagatgctttagtcaaaccagctttacaagaattccgaaataatttactcgaagctgaagctactatccatcaacgcaatcaaaatcgtccgacttacgaatatttgctgccttcaaaaattccacagagtatcaatatttag

SEQ ID NO: 234 - protein, 628 aa, Calothrix parasitica
MTDLSQNNSTSVDKLKLARQEYQYSYIHIPPIAMVDKLPSNENFSTGWLRLLARELKVVFINTLIANRGNRGSENVRDDVRLFFLEVLAKGALPFNLGVTARVLQIIPNLLLKGTSKDFSEIDDLFFSILKESGLSIFQDSLSRVKSLLYEKRPTGHVSSLNDYQKLFPEMEIPKIADNFSTDEQFAYMRVAGYNPVMIERVNKLGDRFPVTEAQYQEVMGDDSLTAAGEEGRLYLADYGILEGAVNGTFPSQQKYIYAPLALFAIPKNSENDESSLMRPVAIQCGQNPQNNPICTPKSDKYAWLFAKTIVQIADANYHEAVTHLGRTHLLVGPFVVATHRQLPDSHPLNILLRPHFEGTLAINNAAQSSLIAAGGGVDKLLASTIDNSRVLAAVGLQSYGFNEAMLPKQLEKRGVNDTQKLPIYPYRDDALLIWNAIHTWVADYLSIYYKDDTSIQNDTYLQNWAIEAGAYDGGRVPDFGQENGLIQTLDYLIDATTLIIFTASAQHAAVNFPQGDMMIYAAAVPLAGYQPASILEGKVTQEDYLNLLPPLEQAQEQLNLVYLLGSIYYKTLGDYSDNYFKDALVKPALQEFRNNLLEAEATIHQRNQNRPTYEYLLPSKIPQSINI

SEQ ID NO: 235 - DNA, 1986 bp, Acaryochloris sp. RCC1774
  CDS (1)..(1986)
atgacagactctaatactgctcaagaagctcagtctcagcaatacgagtatcggtacgacgcctttaaaaatatttcacctaagttgatatatccaatggcagtgaaagtcttacctgctgatcagtcgtttacgaaatggaagtggacgaaaaatgtagtttcccttgtacttagactagttgcaaatcaggccatgcaaaatgtatcactccgaaagggatcggcctgccgcctgattacatttatccgcttatacagaattttagaagatccaaagaacagttcctatattgaaagactctttgatttcatcattagcattgcccgagcgttgacaaatcggttcaagcgcagacctaaatctcaagatattgaacaagatgttaagcaaaaccagaagcccgatcaggtgcaagccagggttgaggcaatggttgatgatattcaacagcaatctaaaacgaaggacccggtaaagcatctttcatttgaggactatcgcaatctatttcagatcatctatttaccggatattagcaatcattttcttgaggatcgctcctttgcagctcaacgggtggcgggggctaacccactggtcattatgcaagtctctgaactccctgagtatttcaaggtaactgaggaacactatacaaaggtgatgggtaaagatgactcccttcaggctgcactagacgaggggcggatctacctggctgactacaagattctggacgaaatcgatccagggactgttgaggtaggggtaaacggtagcatcaaagaaacgattgagaaattcggttatgcacctctagctttgtttgcgatcgcctcgggtgattgtccgggccgtctactgacaccggttgcgattcaatgcagtcaagacgctggcagtctcatttttactccacccagtatagcggctgttgatgaggagcgatgggcttggagaatggcaaagacggtcgttcaggtcgctgatggcaattaccatgaactaatctcacacctaggacgcactcatctgtggattgagccaatagcgctcggtacctaccgtcgtttagcaaaacacaagttaggtaagctccttctgcctcattttgagggtactttcttcatcaataatgctgctgcaggtagcctgattgctaagggtggtgttgtggaaagtattttatcgggtacgttgctatcgtctgtaacgctcagtgttaaggctgcgaagggatacccgtttgcatttaatgattcaatgcttcccaaaacctttgctgctcgtggtgtagatgatccacaaaaattaccggactacccctatcgtgatgatgcgttgctcatttgggatgccattcataagtgggttaagtcataccttgaggtctactacagcagtgatgatgaggtgctaagtgatgccgttttacaggcgtggctagcagaacttgtcgctgaggatgggggccagatgacagagataggagaagtcataccagaggacagaagaccaaaaatccgaacgttggattatttgatcgatgcgacaacgctgattatcttcacttgtagcgttcaacatgcagcagtcaatttcacccaagcatcgttaatgtcgtttgcacccaatatgccactggcaggatttaatgcggctccaacgactcttaaagtcagtgaagcagactacttttcgatgctgccatcacttagcctagctgagcaacaaatgaattttggatatacattaggatccgtgtactacactcaaatcggacaatacaaggctaatgaggtagagctagaggagatgaatcagcatgattactttggtgattcacgaatctctcatcacctagagatttttcagaacaagttgaaagagattgagttgaccattcaacaacggaacgaaactcgtcctactttttacgatattttgctgccgtcaaaaattccgcaatctacaaatatctag

SEQ ID NO: 236 - protein, 661 aa, Acaryochloris sp. RCC1774
MTDSNTAQEAQSQQYEYRYDAFKNISPKLIYPMAVKVLPADQSFTKWKWTKNVVSLVLRLVANQAMQNVSLRKGSACRLITFIRLYRILEDPKNSSYIERLFDFIISIARALTNRFKRRPKSQDIEQDVKQNQKPDQVQARVEAMVDDIQQQSKTKDPVKHLSFEDYRNLFQIIYLPDISNHFLEDRSFAAQRVAGANPLVIMQVSELPEYFKVTEEHYTKVMGKDDSLQAALDEGRIYLADYKILDEIDPGTVEVGVNGSIKETIEKFGYAPLALFAIASGDCPGRLLTPVAIQCSQDAGSLIFTPPSIAAVDEERWAWRMAKTVVQVADGNYHELISHLGRTHLWIEPIALGTYRRLAKHKLGKLLLPHFEGTFFINNAAAGSLIAKGGVVESILSGTLLSSVTLSVKAAKGYPFAFNDSMLPKTFAARGVDDPQKLPDYPYRDDALLIWDAIHKWVKSYLEVYYSSDDEVLSDAVLQAWLAELVAEDGGQMTEIGEVIPEDRRPKIRTLDYLIDATTLIIFTCSVQHAAVNFTQASLMSFAPNMPLAGFNAAPTTLKVSEADYFSMLPSLSLAEQQMNFGYTLGSVYYTQIGQYKANEVELEEMNQHDYFGDSRISHHLEIFQNKLKEIELTIQQRNETRPTFYDILLPSKIPQSTNI

SEQ ID NO: 237 - DNA, 2013 bp, Acaryochloris sp. CCMEE 5410
  CDS (1)..(2013)
atgacgcatcagtactccctcactggcctgccgacccaaatcacgcctgttgaaattcaacaggacaaacatcaacccactctgacctccactcgtcctaatccgacccagccggagccgattcccgcagcgctaaaagcagctcgacgcaaatatcaatacaactacagtcacattgcccctgtagccatggtggatcgcttaccccaagaggaactcccctctcggacttggtggtcaaagttgttccgtaccatgttcaagattctctcgaatgccattgttggcgcccacaatcaccaccatgagcatgaagcagagcaacatatttcccgtctcattcgcaaaaccttggtgaatatcttgactcaacgccccgaggtgcggtggcgtctcatctggcatctgctgaaaacagcaccaacgacgttgattaacggtttacggttgtcgttcgctgattcagaaagcttgctgcacagtttagccgcccatttagagcatgatctattacggattctgcacttgaacttaaaagaacatctagcccatgaatgtagacaagatcgtcctacttcaatagcagactttaatcagcaattcgcgacaattccgttaccggagtgtgccgaatactttcaggaagatgagttttttgcttacttgcgagtagccggtcctaatcctgttttgctgcaacaagtccgtcatttatcgggagacaccctctgctctcatttcccggttacgaatcagcattatcaggccgtgatgggagcagacgattctctgcaaacagcggtcaccgagggccgactatacatcgccgattatgctattttggccggtgcgatcaatggtaactaccccgatcagcaaaaatatatttcggctcccatcgccctttttgctgttccctcagctgatgccccctgccgaaatctccagcccatcgctattcaatgccgccaatctccagggcctgaaacaccgattctgacgccgcctacggatcagaatccagaccaaaaacaggcctgggacatggcgaagacctgcgtgcaagttgccgatagcaattaccacgaggccgtcacccatttgggtcgaacccatctgtttattagcccgtttgtaattgccacccatcgccaattactgccgtctcatcctgtgagtgtcctgcttcggcctcactttgaaggcaccttaagtatcaacaacggcgctcaaagcatgttaatggcgccagaaggtggagtggatacggtcttggctgccaccatcgactgtgccagggtcttagccgtaaagggattacaaagctattcctttaatcaggccatgctgccccaacaattgcagcaactgggtttggataatgcagcggcactgcccatccatccctatcgagacgatgccttgctgatttggcaggccatcgaaacttgggtcactgattatgtgagcttgtactacccaacagatgactccgtgcaaaaagatgcggcccttcaggcttgggcgcaggagctacaggctgaagagggtggccgagtcccagattttggtgaggatggacaattgcgaacccaggcctacttaattcaagccctcacgctgatcatttttaccgcgagtgcccaacatgccgctgtgaattttccccagggcgacatcatggtctataccccagggatgccattagcaggctaccagcccgctcccaacacgacagcgatgtcttcccaggatcggctcaaccaactgccccccctacaccaggccttaaatcagctggagttaacgtatttgctcgggcagatttaccatacgcaactcggtcaatacgaaaagtcctggttctctgatcagcgtgtactcgcgcctctgcatcgttttcaggccaatttactggatatcgaaactgcgatcgcagaacgaaaccgccatcgcccctacccttaccgctacctacagccgtccaacattccccagagcatcaatatctag

SEQ ID NO: 238 - protein, 670 aa, Acaryochloris sp. CCMEE 5410
MTHQYSLTGLPTQITPVEIQQDKHQPTLTSTRPNPTQPEPIPAALKAARRKYQYNYSHIAPVAMVDRLPQEELPSRTWWSKLFRTMFKILSNAIVGAHNHHHEHEAEQHISRLIRKTLVNILTQRPEVRWRLIWHLLKTAPTTLINGLRLSFADSESLLHSLAAHLEHDLLRILHLNLKEHLAHECRQDRPTSIADFNQQFATIPLPECAEYFQEDEFFAYLRVAGPNPVLLQQVRHLSGDTLCSHFPVTNQHYQAVMGADDSLQTAVTEGRLYIADYAILAGAINGNYPDQQKYISAPIALFAVPSADAPCRNLQPIAIQCRQSPGPETPILTPPTDQNPDQKQAWDMAKTCVQVADSNYHEAVTHLGRTHLFISPFVIATHRQLLPSHPVSVLLRPHFEGTLSINNGAQSMLMAPEGGVDTVLAATIDCARVLAVKGLQSYSFNQAMLPQQLQQLGLDNAAALPIHPYRDDALLIWQAIETWVTDYVSLYYPTDDSVQKDAALQAWAQELQAEEGGRVPDFGEDGQLRTQAYLIQALTLIIFTASAQHAAVNFPQGDIMVYTPGMPLAGYQPAPNTTAMSSQDRLNQLPPLHQALNQLELTYLLGQIYHTQLGQYEKSWFSDQRVLAPLHRFQANLLDIETAIAERNRHRPYPYRYLQPSNIPQSINI

SEQ ID NO: 239 - protein, 569 aa, Cyanothece sp. PCC 8801
MVQPSLPQDDTPDQQEQRNRAIAQQREAYQYSETAGILLIKTLPQSEMFSLKYLIERDKGLVSLIANTLASNIENIFDPFDKLEDFEEMFPLLPKPLVMNTFRNDRVFARQRIAGPNPMVIERVVDKLPDNFPVTDAMFQKIMFTKKTLAEAIAQGKLFITNYKGLAELSPGRYEYQKNGTLVQKTKTIAAPLVLYAWKPEGFGDYRGSLAPIAIQINQQPDPITNPIYTPRDGKHWFIAKIFAQMADGNCHEAISHLARTHLILEPFVLATANELAPNHPLSVLLKPHFQFTLAINELAREQVISAGGYADDLLAGTLEASIAVIKAAIKEYMDNFTEFALPRELARRGVGIGDVDQRGENFLPDYPYRDDAMLLWNAIEVYVRDYLSLYYQSPVQIRQDTELQNWVRRLVSPEGGRVTGLVSNGELNTIEALVAIATQVIFVSGPQHAAVNYPQYDYMAFIPNMPLATYATPPNKESNISEATILNILPPQKLAARQLELMRTLCVFYPNRLGYPDTEFVDVRAQQVLHQFQERLQEIEQRIVLCNEKRLEPYTYLLPSNVPNSTSI

SEQ ID NO: 240 - protein, 30 aa, Artificial Sequence
  Partial consensus sequence pattern of SEQ ID NO.54
  MISC_FEATURE (3)..(7): Xaa can be any naturally occurring amino acid
  MISC_FEATURE (10)..(17): Xaa can be any naturally occurring amino acid
  MISC_FEATURE (19)..(22): Xaa can be any naturally occurring amino acid
  MISC_FEATURE (24)..(27): Xaa can be any naturally occurring amino acid
  MISC_FEATURE (29)..(29): Xaa can be any naturally occurring amino acid
AKXXXXXADXXXXXXXXHXXXXHXXXXPXA

SEQ ID NO: 241 - protein, 45 aa, Artificial Sequence
  Partial consensus sequence pattern of SEQ ID NO.54
  MISC_FEATURE (2)..(2): Xaa can be any naturally occurring amino acid
  MISC_FEATURE (4)..(13): Xaa can be any naturally occurring amino acid
  MISC_FEATURE (15)..(28): Xaa can be any naturally occurring amino acid
  MISC_FEATURE (30)..(32): Xaa can be any naturally occurring amino acid
  MISC_FEATURE (34)..(35): Xaa can be any naturally occurring amino acid
  MISC_FEATURE (37)..(38): Xaa can be any naturally occurring amino acid
  MISC_FEATURE (40)..(44): Xaa can be any naturally occurring amino acid
VXGXXXXXXXXXXLXXXXXXXXXXXXXXHXXXNXXQXXYXXXXXN

SEQ ID NO: 242 - protein, 31 aa, Artificial Sequence
  partial consensus sequence pattern of SEQ ID NO:54
  MISC_FEATURE (2)..(7): Xaa can be any naturally occurring amino acid
  MISC_FEATURE (9)..(11): Xaa can be any naturally occurring amino acid
  MISC_FEATURE (13)..(18): Xaa can be any naturally occurring amino acid
  MISC_FEATURE (20)..(23): Xaa can be any naturally occurring amino acid
  MISC_FEATURE (25)..(29): Xaa can be any naturally occurring amino acid
LXXXXXXIXXXNXXXXXXYXXXXPXXXXXSI

SEQ ID NO: 243 - protein, 51 aa, Artificial Sequence
  partial consensus sequence pattern of SEQ ID NO:53
  MISC_FEATURE (2)..(6): Xaa can be any naturally occurring amino acid
  MISC_FEATURE (8)..(12): Xaa can be any naturally occurring amino acid
  MISC_FEATURE (13)..(13): Xaa represents 0 to 7 identical or different natural amino acid residues
  MISC_FEATURE (14)..(19): Xaa can be any naturally occurring amino acid
  MISC_FEATURE (20)..(20): Xaa represents 0 or 1 natural amino acid residue
  MISC_FEATURE (22)..(28): Xaa can be any naturally occurring amino acid
  MISC_FEATURE (30)..(30): Xaa can be any naturally occurring amino acid
  MISC_FEATURE (33)..(33): Xaa can be any naturally occurring amino acid
  MISC_FEATURE (35)..(37): Xaa can be any naturally occurring amino acid
  MISC_FEATURE (39)..(39): Xaa can be any naturally occurring amino acid
  MISC_FEATURE (41)..(43): Xaa can be any naturally occurring amino acid
  MISC_FEATURE (44)..(44): Xaa represents 0 to 7 identical or different natural amino acid residues
  MISC_FEATURE (45)..(47): Xaa can be any naturally occurring amino acid
  MISC_FEATURE (49)..(50): Xaa can be any naturally occurring amino acid
LXXXXXYXXXXXXXXXXXXXGXXXXXXXKXLPXPXXXFXWXXXXXXXPXXI

SEQ ID NO: 244 - protein, 33 aa, Artificial Sequence
  partial consensus sequence pattern of SEQ ID NO:53
  MISC_FEATURE (2)..(3): Xaa can be any naturally occurring amino acid
  MISC_FEATURE (6)..(6): Xaa can be any naturally occurring amino acid
  MISC_FEATURE (8)..(8): Xaa can be any naturally occurring amino acid
  MISC_FEATURE (10)..(10): Xaa can be any naturally occurring amino acid
  MISC_FEATURE (13)..(14): Xaa can be any naturally occurring amino acid
  MISC_FEATURE (16)..(16): Xaa can be any naturally occurring amino acid
  MISC_FEATURE (18)..(20): Xaa can be any naturally occurring amino acid
  MISC_FEATURE (22)..(25): Xaa can be any naturally occurring amino acid
  MISC_FEATURE (27)..(28): Xaa can be any naturally occurring amino acid
  MISC_FEATURE (30)..(30): Xaa can be any naturally occurring amino acid
  MISC_FEATURE (32)..(32): Xaa can be any naturally occurring amino acid
WXXAKXCXQXADXXHXEXXXHXXXXHXXMXPXA

SEQ ID NO: 245 - protein, 53 aa, Artificial Sequence
  partial consensus sequence pattern of SEQ ID NO:53
  MISC_FEATURE (2)..(2): Xaa can be any naturally occurring amino acid
  MISC_FEATURE (4)..(4): Xaa can be any naturally occurring amino acid
  MISC_FEATURE (6)..(15): Xaa can be any naturally occurring amino acid
  MISC_FEATURE (17)..(26): Xaa can be any naturally occurring amino acid
  MISC_FEATURE (28)..(28): Xaa can be any naturally occurring amino acid
  MISC_FEATURE (30)..(30): Xaa can be any naturally occurring amino acid
  MISC_FEATURE (32)..(34): Xaa can be any naturally occurring amino acid
  MISC_FEATURE (36)..(37): Xaa can be any naturally occurring amino acid
  MISC_FEATURE (39)..(40): Xaa can be any naturally occurring amino acid
  MISC_FEATURE (42)..(46): Xaa can be any naturally occurring amino acid
  MISC_FEATURE (50)..(50): Xaa can be any naturally occurring amino acid
  MISC_FEATURE (52)..(52): Xaa can be any naturally occurring amino acid
GXVXGXXXXXXXXXXLXXXXXXXXXXCXPXHXXXNXXQXXYXXXXXNMPXAXY

SEQ ID NO: 246 - protein, 24 aa, Artificial Sequence
  partial consensus sequence pattern of SEQ ID NO:53
  MISC_FEATURE (2)..(7): Xaa can be any naturally occurring amino acid
  MISC_FEATURE (9)..(13): Xaa can be any naturally occurring amino acid
  MISC_FEATURE (15)..(16): Xaa can be any naturally occurring amino acid
  MISC_FEATURE (18)..(18): Xaa can be any naturally occurring amino acid
  MISC_FEATURE (20)..(22): Xaa can be any naturally occurring amino acid
  MISC_FEATURE (23)..(23): Xaa represents 0 to 8 identical or different natural amino acid residues
QXXXXXXLXXXXXDXXGXYXXXXF

SEQ ID NO: 247 - protein, 34 aa, Artificial Sequence
  partial consensus sequence pattern of SEQ ID NO:53
  MISC_FEATURE (2)..(3): Xaa can be any naturally occurring amino acid
  MISC_FEATURE (5)..(10): Xaa can be any naturally occurring amino acid
  MISC_FEATURE (12)..(14): Xaa can be any naturally occurring amino acid
  MISC_FEATURE (16)..(17): Xaa can be any naturally occurring amino acid
  MISC_FEATURE (19)..(21): Xaa can be any naturally occurring amino acid
  MISC_FEATURE (23)..(31): Xaa can be any naturally occurring amino acid
QXXLXXXXXXIXXXNXXRXXXYXXXXXXXXXNSI

SEQ ID NO: 248 - protein, 51 aa, Artificial Sequence
  partial consensus sequence pattern of SEQ ID NO:52
  MISC_FEATURE (2)..(6): Xaa can be any naturally occurring amino acid
  MISC_FEATURE (8)..(12): Xaa can be any naturally occurring amino acid
  MISC_FEATURE (13)..(13): Xaa represents 0 to 7 identical or different natural amino acid residues
  MISC_FEATURE (14)..(19): Xaa can be any naturally occurring amino acid
  MISC_FEATURE (20)..(20): Xaa represents 0 or 1 natural amino acid residue
  MISC_FEATURE (23)..(28): Xaa can be any naturally occurring amino acid
  MISC_FEATURE (30)..(30): Xaa can be any naturally occurring amino acid
  MISC_FEATURE (33)..(33): Xaa can be any naturally occurring amino acid
  MISC_FEATURE (35)..(35): Xaa can be any naturally occurring amino acid
  MISC_FEATURE (37)..(37): Xaa can be any naturally occurring amino acid
  MISC_FEATURE (39)..(39): Xaa can be any naturally occurring amino acid
  MISC_FEATURE (41)..(43): Xaa can be any naturally occurring amino acid
  MISC_FEATURE (44)..(44): Xaa represents 0 to 6 identical or different natural amino acid residues
  MISC_FEATURE (45)..(47): Xaa can be any naturally occurring amino acid
  MISC_FEATURE (49)..(50): Xaa can be any naturally occurring amino acid
LXXXXXYXXXXXXXXXXXXXGGXXXXXXKXLPXPXAXFXWXXXXXXXPXXI

SEQ ID NO: 249 - protein, 36 aa, Artificial Sequence
  partial consensus sequence pattern of SEQ ID NO:52
  MISC_FEATURE (2)..(3): Xaa can be any naturally occurring amino acid
  MISC_FEATURE (6)..(6): Xaa can be any naturally occurring amino acid
  MISC_FEATURE (8)..(8): Xaa can be any naturally occurring amino acid
  MISC_FEATURE (10)..(10): Xaa can be any naturally occurring amino acid
  MISC_FEATURE (13)..(13): Xaa can be any naturally occurring amino acid
  MISC_FEATURE (16)..(16): Xaa can be any naturally occurring amino acid
  MISC_FEATURE (18)..(20): Xaa can be any naturally occurring amino acid
  MISC_FEATURE (22)..(24): Xaa can be any naturally occurring amino acid
  MISC_FEATURE (27)..(27): Xaa can be any naturally occurring amino acid
  MISC_FEATURE (30)..(30): Xaa can be any naturally occurring amino acid
  MISC_FEATURE (32)..(32): Xaa can be any naturally occurring amino acid
  MISC_FEATURE (34)..(35): Xaa can be any naturally occurring amino acid
WXXAKXCXQXADXNHXEXXXHXXXTHXVMXPXAXXT

SEQ ID NO: 250 - protein, 53 aa, Artificial Sequence; identical to SEQ ID NO: 245
  partial consensus sequence pattern of SEQ ID NO:52
  MISC_FEATURE (2)..(2): Xaa can be any naturally occurring amino acid
  MISC_FEATURE (4)..(4): Xaa can be any naturally occurring amino acid
  MISC_FEATURE (6)..(15): Xaa can be any naturally occurring amino acid
  MISC_FEATURE (17)..(26): Xaa can be any naturally occurring amino acid
  MISC_FEATURE (28)..(28): Xaa can be any naturally occurring amino acid
  MISC_FEATURE (30)..(30): Xaa can be any naturally occurring amino acid
  MISC_FEATURE (32)..(34): Xaa can be any naturally occurring amino acid
  MISC_FEATURE (36)..(37): Xaa can be any naturally occurring amino acid
  MISC_FEATURE (39)..(40): Xaa can be any naturally occurring amino acid
  MISC_FEATURE (42)..(46): Xaa can be any naturally occurring amino acid
  MISC_FEATURE (50)..(50): Xaa can be any naturally occurring amino acid
  MISC_FEATURE (52)..(52): Xaa can be any naturally occurring amino acid

SEQ ID NO: 251 - protein, 24 aa, Artificial Sequence
  partial consensus sequence pattern of SEQ ID NO:52
  MISC_FEATURE (2)..(7): Xaa can be any naturally occurring amino acid
  MISC_FEATURE (9)..(12): Xaa can be any naturally occurring amino acid
  MISC_FEATURE (15)..(15): Xaa can be any naturally occurring amino acid
  MISC_FEATURE (18)..(18): Xaa can be any naturally occurring amino acid
  MISC_FEATURE (20)..(22): Xaa can be any naturally occurring amino acid
  MISC_FEATURE (23)..(23): Xaa represents 0 to 8 identical or different natural amino acid residues
QXXXXXXLXXXXYDXLGXYXXXXF

SEQ ID NO: 252 - protein, 35 aa, Artificial Sequence
  partial consensus sequence pattern of SEQ ID NO:52
  MISC_FEATURE (3)..(4): Xaa can be any naturally occurring amino acid
  MISC_FEATURE (6)..(11): Xaa can be any naturally occurring amino acid
  MISC_FEATURE (13)..(15): Xaa can be any naturally occurring amino acid
  MISC_FEATURE (17)..(18): Xaa can be any naturally occurring amino acid
  MISC_FEATURE (20)..(22): Xaa can be any naturally occurring amino acid
  MISC_FEATURE (24)..(27): Xaa can be any naturally occurring amino acid
  MISC_FEATURE (29)..(32): Xaa can be any naturally occurring amino acid
FQXXLXXXXXXIXXXNXXRXXXYXXXXPXXXXNSI

SEQ ID NO: 253 - DNA, 1773 bp, Artificial Sequence
  Codon-optimized coding sequence of WP_002738122.1mut
atggtgaacaccccgccgccgaccccgtgcctgccgcagaacgagccggatgcgaaccgtcgtgcggatagcctgaacctgcagcgtcaagcgtaccgttatgactaccagtatctgccgccgctggtgctgatggagagcgttccggcggcggaaaacttcagctttcaatatattaccgaacgtctggcggcgaccgcggaactgccggcgaacatgctggcggtgaaggttaaaagcttcctggacccgctggatgagctgcaggactacgaagatttctttgcgatcattccgctgccgaagatcgcgaaagtgtatcagaccaacgatgcgtttgcggaacaacgtctgagcggtgcgaacccgctggttctgcacctgctgaagccgggtgatgcgcgtgcgcaggttctgaaccaaattccgagcagcaaaaccgatttcgagccgctgtttcaggttaaccaagaactggcggcgggcaacatctacatttgcgactataccggcaccgatatcaactacctgggtccgagcctgattcagggtggcacccacgcgaagggtcgtaaatatctgccgaagccgcgtgcgttcttttggtggcgtaagagcggcatccgtgaccgtggtaaactggtgccgatcgcgattcagttcggcgagaacgcggaaaagctgtacaccccgttcgagaaaaacccgctggcgtggctgtttgcgaagatttgcgtgcaagttgcggatagcaaccaccacgaaatgaacagccacctgtgccgtacccacttcgttatggagccgatcgcgatttgcaccgcgcgtcagctggcggaaaaccacccgctgagcctgctgctgaaaccgcacctgcgttttatgctgaccaacaacagcctgggtcaagagcgtctgatcaacccgggtggcccggtggatgagctgctggcgggcaccctgggtgaaagcatggcgctggttaaggacgcgtacgcgaactggaacctgcgtgatttcgcgtttccgaaagagattagcaaccgtggcatggacgataccgaacgtctgccgcactacccgtatcgtgacgatggtatgctggtgtggcagagcatcaaccaattcgttagcgactacctgcactacttttatccgaacccgcaggacattaccaacgatcaggagctgcaagcgtgggcgggtgaatgcagcaacagcgcggcggatcaaggtggcaacgtgaagggtatgccggcgaacttcaccgacgttgaggatctgatcgaagtggttaccaccatcatttttatttgcggcccgctgcacagcgcggttaactacggccagtacgactatatgacctttgcggcgaacatgccgctggcggcgtattgcgacctgccggaggcgatcaaggataccaccggtagcatcattggcgacgcgcgtggtagcatcaccgaaaaagatattctgcagctgctgccgccgtacaagaaagcggcggatcagctgcaaagcctgttcaccctgagcgactaccgttatgatcaactgggctactatgacaaggcgtttcgtgagctgtatggtcgtaaattcgaggaagtgtttgcggaaggcgatcaggcgaccatcaccggtttcctgcgtcaatttcagcaaaacctgaacatgaacgagcaggaaatcgacgcgaacaaccaaaagcgtattgttccgtacacctatctgaaaccgagcctgattctgaacagcatcagcatttaa

SEQ ID NO: 254 - protein, 590 aa, Artificial Sequence
  Amino acid sequence for WP_002738122.1mut
MVNTPPPTPCLPQNEPDANRRADSLNLQRQAYRYDYQYLPPLVLMESVPAAENFSFQYITERLAATAELPANMLAVKVKSFLDPLDELQDYEDFFAIIPLPKIAKVYQTNDAFAEQRLSGANPLVLHLLKPGDARAQVLNQIPSSKTDFEPLFQVNQELAAGNIYICDYTGTDINYLGPSLIQGGTHAKGRKYLPKPRAFFWWRKSGIRDRGKLVPIAIQFGENAEKLYTPFEKNPLAWLFAKICVQVADSNHHEMNSHLCRTHFVMEPIAICTARQLAENHPLSLLLKPHLRFMLTNNSLGQERLINPGGPVDELLAGTLGESMALVKDAYANWNLRDFAFPKEISNRGMDDTERLPHYPYRDDGMLVWQSINQFVSDYLHYFYPNPQDITNDQELQAWAGECSNSAADQGGNVKGMPANFTDVEDLIEVVTTIIFICGPLHSAVNYGQYDYMTFAANMPLAAYCDLPEAIKDTTGSIIGDARGSITEKDILQLLPPYKKAADQLQSLFTLSDYRYDQLGYYDKAFRELYGRKFEEVFAEGDQATITGFLRQFQQNLNMNEQEIDANNQKRIVPYTYLKPSLILNSISI

SEQ ID NO: 255 - DNA, 1773 bp, Artificial Sequence
  Codon-optimized coding sequence of WP_002738122.1mut2
atggtgaacaccccgccgccgaccccgtgcctgccgcagaacgagccggatgcgaaccgtcgtgcggatagcctgaacctgcagcgtcaagcgtaccgttatgactaccagtatctgccgccgctggtgctgatggagagcgttccggcggcggaaaacttcagctttcaatatattaccgaacgtctggcggcgaccgcggaactgccggcgaacatgctggcggtgaaggttaaaagcttcctggacccgctggatgagctgcaggactacgaagatttctttgcgatcattccgctgccgaagatcgcgaaagtgtatcagaccaacgatgcgtttgcggagcaacgtctgagcggtgcgaacccgctggttctgcacctgctgaagccgggtgatgcgcgtgcgcaggttctgaaccaaattccgagcagcaaaaccgatttcgaaccgctgtttcaggttgagcaagaactggcggcgggcaacatctacatttgcgactataccggcaccgatatcaactacctgggtccgtgcatgattcagggtggcacccacgcgaagggtcgtaaatatctgccgaagccgcgtgcgttcttttggtggcgtaagagcggcatccgtgaccgtggtaaactggtgccgatcgcgattcagttcggcgagaacgcggaaaagctgtacaccccgttcgagaaaaacccgctggcgtggctgtttgcgaagatttgcgtgcaagttgcggatagcaaccaccacgaaatgaacagccacctgtgccgtacccacttcgttatggagccgatcgcgatttgcaccgcgcgtcagctggcggaaaaccacccgctgagcctgctgctgaaaccgcacctgcgttttatgctgaccaacaaccacctgggtcaagaacgtctgatcaacccgggtggcccggtggatgagctgctggcgggcaccctgggtgaaagcatggcgctggttaaggacgcgtacgcgaactggaacctgcgtgatttcgcgtttccgaaagagattagcaaccgtggcatggacgataccgaacgtctgccgcactacccgtatcgtgacgatggtatgctggtgtggcagagcatcaaccaattcgttagcgactacctgcactacttttatccgaacccgcaggacattaccaacgatcaggagctgcaagcgtgggcgggtgaatgcagcaacagcgcggcggatcaaggtggcaacgtgaagggtatgccggcgaacttcaccgacgttgaggatctgatcgaagtggttaccaccatcatttttatttgcggcccgctgcacagcgcggttaactacggccagtacgactatatgacctttgcggcgaacatgccgctggcggcgtattgcgacctgccggaggcgatcaaggataccaccggtagcatcattggcgacgcgcgtggtagcatcaccgaaaaagatattctgcagctgctgccgccgtacaagaaagcggcggatcagctgcaaagcctgttcaccctgagcgactaccgttatgatcaactgggctactatgacaaggcgtttcgtgagctgtatggtcgtaaattcgaggaagtgtttgcggaaggcgatcaggcgaccatcaccggtttcctgcgtcaatttcagcaaaacctgaacatgaacgagcaggaaatcgacgcgaacaaccaaaagcgtattgttccgtacacctatctgaaaccgagcctgattctgaacagcatcagcatttaa

SEQ ID NO: 256 - protein, 590 aa, Artificial Sequence
  Amino acid sequence for WP_002738122.1mut2
MVNTPPPTPCLPQNEPDANRRADSLNLQRQAYRYDYQYLPPLVLMESVPAAENFSFQYITERLAATAELPANMLAVKVKSFLDPLDELQDYEDFFAIIPLPKIAKVYQTNDAFAEQRLSGANPLVLHLLKPGDARAQVLNQIPSSKTDFEPLFQVEQELAAGNIYICDYTGTDINYLGPCMIQGGTHAKGRKYLPKPRAFFWWRKSGIRDRGKLVPIAIQFGENAEKLYTPFEKNPLAWLFAKICVQVADSNHHEMNSHLCRTHFVMEPIAICTARQLAENHPLSLLLKPHLRFMLTNNHLGQERLINPGGPVDELLAGTLGESMALVKDAYANWNLRDFAFPKEISNRGMDDTERLPHYPYRDDGMLVWQSINQFVSDYLHYFYPNPQDITNDQELQAWAGECSNSAADQGGNVKGMPANFTDVEDLIEVVTTIIFICGPLHSAVNYGQYDYMTFAANMPLAAYCDLPEAIKDTTGSIIGDARGSITEKDILQLLPPYKKAADQLQSLFTLSDYRYDQLGYYDKAFRELYGRKFEEVFAEGDQATITGFLRQFQQNLNMNEQEIDANNQKRIVPYTYLKPSLILNSISI

SEQ ID NO: 257 - DNA, 1929 bp, Artificial Sequence
  Codon-optimized coding sequence of WP_015204462.1mut
atgccgcaaccgtgcctgccgcagaacgagccgaacccggaaaaacgtaacaacgacctgagcgatcagcaacaggcgtacgagtatgattacaagtatctgccgccgctggtgctgctgaagaaaattccggcgttcgaaaactttagcgcgcagtacatcgcggaacgtgtggttgcgaccagcgagctggttccgaacatgctggcggcgaaagcgcgtagctttctggacccgctggacgatatcaaggactacgaggacctgttcaccctgctgccgctgccggaagtggcgaaagtttatcaaaccaacaacagctttgcggagcagcgtctgagcggtgcgaacccgttcgtgattcgtctgctggacgaggacgatgcgcgtagccaagttctggaacagatcccgagcttcaaagacgattttgagccgctgttcgatgtgcgtaaggaactggcggcgggtaacatctacatttgcgactataccggcaccgatgagtactatcgtggcccgagcatggttcagggtggcacctacgaaaagggccgtaaatatctgccgaaaccgctggcgttcttttggtggcaacgtaccggtattagcgaccgtggcaagctggtgccgatcgcgattcagctggatgcgagcaagaacagcaaagtgtacaccccgaccaacagcaaagtttataccccgtttgagcaaaacccgctggactggctgttcgcgaagctgtgcgtgcagatcgcggatggtaaccaccacgaaatgagcagccacctgtgccgtacccacttcgttatggagccgatcgcgatttgcaccgcgcaccagctggcggaaaaccacccgctgagcctgctgctgcgtccgcacttcctgtttatgctgaccaacaacagcctgggccaacagcgtctgatcaacccgggtggcccggtggatgagctgctggcgggcaccctgccggagagcatggaactggttaaggatgcgtacgagggctggaacattaaagaattcgcgtttccgaccgagatcaagaaccgtggtatggacaacaccgaacgtctgccgcactacccgtatcgtgacgatggcatgctggtttggaaagcgattcacacctttgtgagcgattacgttaaccacttctatccgaccccggaagacatcaccggtgataccgagctgcaagcgtgggcgaaggaatgcagcgaccaaagcgcgcagaccaacggtggcaaggtgaaaggcatgccgaccagctttaccaccgtgcaggagctgatcgaaattgttaccaccatcattttcatttgcggtccgcaacacagcgcggttaactacgcgcaggatggctatatgacctttgcggcgaacatgccgctggcggcgtaccgtgacatcccgaagcagagccacaaaccgcaggatcaaccgaccgcgaccccgagcgtggcggttcaaaccaccgcggagcagaccaccgcggaacaaaccaaggcggtggaaattaccgcggacaaagcgaccctggatcagaacaccgttctgcaaaaacgtgcggtgcagaccaccaccgttgagatcccggaagaccaaattaccgaggaacagatcctgaagctgctgccgccgtacaaacgtaccgcggaccaactgcagagcctgtttgtgctgagcgcgtaccaatatgatcgtctgggttactatgagaaggcgttccaacagctgtacaacgacaagttcgaagatgttttcaaggacgataacaaccaagcgatcattgcgattgtgcgtcagttccaacagaacctgaacatggttgagcaggaaatcgacgcgaacaacaagaaacgtgtggttccgtacctgtatctgaagccgagcctgatcctgaacagcatcagcatttaa

SEQ ID NO: 258 - protein, 642 aa, Artificial Sequence
  Amino acid sequence for WP_015204462.1mut
MPQPCLPQNEPNPEKRNNDLSDQQQAYEYDYKYLPPLVLLKKIPAFENFSAQYIAERVVATSELVPNMLAAKARSFLDPLDDIKDYEDLFTLLPLPEVAKVYQTNNSFAEQRLSGANPFVIRLLDEDDARSQVLEQIPSFKDDFEPLFDVRKELAAGNIYICDYTGTDEYYRGPSMVQGGTYEKGRKYLPKPLAFFWWQRTGISDRGKLVPIAIQLDASKNSKVYTPTNSKVYTPFEQNPLDWLFAKLCVQIADGNHHEMSSHLCRTHFVMEPIAICTAHQLAENHPLSLLLRPHFLFMLTNNSLGQQRLINPGGPVDELLAGTLPESMELVKDAYEGWNIKEFAFPTEIKNRGMDNTERLPHYPYRDDGMLVWKAIHTFVSDYVNHFYPTPEDITGDTELQAWAKECSDQSAQTNGGKVKGMPTSFTTVQELIEIVTTIIFICGPQHSAVNYAQDGYMTFAANMPLAAYRDIPKQSHKPQDQPTATPSVAVQTTAEQTTAEQTKAVEITADKATLDQNTVLQKRAVQTTTVEIPEDQITEEQILKLLPPYKRTADQLQSLFVLSAYQYDRLGYYEKAFQQLYNDKFEDVFKDDNNQAIIAIVRQFQQNLNMVEQEIDANNKKRVVPYLYLKPSLILNSISI

SEQ ID NO: 259 - DNA, 1929 bp, Artificial Sequence
  Codon-optimized coding sequence of WP_015204462.1mut2
atgccgcaaccgtgcctgccgcagaacgagccgaacccggaaaaacgtaacaacgacctgagcgatcagcaacaggcgtacgagtatgattacaagtatctgccgccgctggtgctgctgaagaaaattccggcgttcgaaaactttagcgcgcagtacatcgcggaacgtgtggttgcgaccagcgagctggttccgaacatgctggcggcgaaagcgcgtagctttctggacccgctggacgatatcaaggactacgaggacctgttcaccctgctgccgctgccggaagtggcgaaagtttatcaaaccaacaacagctttgcggagcagcgtctgagcggtgcgaacccgttcgtgattcgtctgctggacgaggacgatccgcgtagccaagttctggaacagatcccgagcttcaaagacgattttgagccgctgttcgatgtgcgtaaggaactggcggcgggtaacatctacatttgcgactataccggcaccgatgagtactatcgtggcccgagcatggttcagggtggcacctacgaaaagggccgtaaatatctgccgaaaccgctggcgttcttttggtggcaacgtaccggtattagcgaccgtggcaagctggtgccgatcgcgattcagctggatgcgagcaagaacagcaaagtgtacaccccgaccaacagcaaagtttataccccgtttgagcaaaacccgctggactggctgttcgcgaagctgtgcgtgcagatcgcggatagcaaccaccacgaaatgagcagccacctgtgccgtacccacttcgttatggagccgatcgcgatttgcaccgcgcaccagctggcggaaaaccacccgctgagcctgctgctgcgtccgcacttcctgtttatgctgaccaacaacagcctgggtcaacagcgtctgatcaacccgggtggcccggtggatgagctgctggcgggcaccctgccggagagcatggaactggttaaggatgcgtacgagggctggaacattaaagaattcgcgtttccgaccgagatcaagaaccgtggtatggacaacaccgaacgtctgccgcactacccgtatcgtgacgatggcatgctggtttggaaagcgattcacacctttgtgagcgattacgttaaccacttctatccgaccccggaagacatcaccggtgataccgagctgcaagcgtgggcgaaggaatgcagcgaccaaagcgcgcagaccaacggtggcaaggtgaaaggcatgccgaccagctttaccaccgtgcaggagctgatcgaaattgttaccaccatcattttcatttgcggtccgcaacacagcgcggttaactacgcgcaggatggctatatgacctttgcggcgaacatgccgctggcggcgtaccgtgacatcccgaagcagagccacaaaccgcaggatcaaccgaccgcgaccccgagcgtggcggttcaaaccaccgcggagcagaccaccgcggaacaaaccaaggcggtggaaattaccgcggacaaagcgaccctggatcagaacaccgttctgcaaaaacgtgcggtgcagaccaccaccgttgagatcccggaagaccaaattaccgaggaacagatcctgaagctgctgccgccgtacaaacgtaccgcggaccaactgcagagcctgtttgtgctgagcgcgtaccaatatgatcgtctgggttactatgagaaggcgttccaacagctgtatggcgacaagtttgaagatgttttcaaagacgataacaaccaagcgatcattgcgattgtgcgtcagttccaacagaacctgaacatggttgagcaggaaatcgacgcgaacaacaagaaacgtgtggttccgtacctgtatctgaagccgagcctgatcctgaacagcatcagcatttaa

SEQ ID NO: 260 - protein, 642 aa, Artificial Sequence
  Amino acid sequence for WP_015204462.1mut2
MPQPCLPQNEPNPEKRNNDLSDQQQAYEYDYKYLPPLVLLKKIPAFENFSAQYIAERVVATSELVPNMLAAKARSFLDPLDDIKDYEDLFTLLPLPEVAKVYQTNNSFAEQRLSGANPFVIRLLDEDDPRSQVLEQIPSFKDDFEPLFDVRKELAAGNIYICDYTGTDEYYRGPSMVQGGTYEKGRKYLPKPLAFFWWQRTGISDRGKLVPIAIQLDASKNSKVYTPTNSKVYTPFEQNPLDWLFAKLCVQIADSNHHEMSSHLCRTHFVMEPIAICTAHQLAENHPLSLLLRPHFLFMLTNNSLGQQRLINPGGPVDELLAGTLPESMELVKDAYEGWNIKEFAFPTEIKNRGMDNTERLPHYPYRDDGMLVWKAIHTFVSDYVNHFYPTPEDITGDTELQAWAKECSDQSAQTNGGKVKGMPTSFTTVQELIEIVTTIIFICGPQHSAVNYAQDGYMTFAANMPLAAYRDIPKQSHKPQDQPTATPSVAVQTTAEQTTAEQTKAVEITADKATLDQNTVLQKRAVQTTTVEIPEDQITEEQILKLLPPYKRTADQLQSLFVLSAYQYDRLGYYEKAFQQLYGDKFEDVFKDDNNQAIIAIVRQFQQNLNMVEQEIDANNKKRVVPYLYLKPSLILNSISI

SEQ ID NO: 261 - DNA, 1929 bp, Artificial Sequence
  Codon-optimized coding sequence of WP_015204462.1mut3
atgccgcaaccgtgcctgccgcagaacgagccgaacccggaaaaacgtaacaacgacctgagcgatcagcaacaggcgtacgagtatgattacaagtatctgccgccgctggtgctgctgaagaaaattccggcgttcgaaaactttagcgcgcagtacatcgcggaacgtgtggttgcgaccagcgagctggttccgaacatgctggcggcgaaagcgcgtagctttctggacccgctggacgatatcaaggactacgaggacctgttcaccctgctgccgctgccggaagtggcgaaagtttatcaaaccaacaacagctttgcggagcagcgtctgagcggtgcgaacccgttcgtgattcgtctgctggacgaggacgatgcgcgtagccaagttctggaacagatcccgagcttcaaagacgattttgaaccgctgttcgatgtggagaaggaactggcggcgggtaacatctacatttgcgactataccggcaccgatgagtactatcgtggcccgagcatggttcaaggtggcacctacgaaaagggccgtaaatatctgccgaagccgctggcgttcttttggtggcagcgtaccggtattagcgaccgtggccaactggtgccgatcgcgattcagctggacccgagcaagaacagcaaagtgtacaccccgaccaacagcaaagtttataccccgtttgagcaaaacccgctggactggctgttcgcgaagctgtgcgtgcagatcgcggatgcgaaccaccacgaaatgagcagccacctgtgccgtacccacttcgttatggagccgatcgcgatttgcaccgcgcaccagctggcggaaaaccacccgctgagcctgctgctgcgtccgcacttcctgtttatgctgaccaacaacagcctgggccaacagcgtctgatcaacccgggtggcccggtggatgagctgctggcgggcaccctgccggagagcatggaactggttaaggatgcgtacgagggctggaacattaaagagttcgcgtttccgaccgagatcaagaaccgtggtatggacaacaccgaacgtctgccgcactacccgtatcgtgacgatggcatgctggtttggaaagcgattcacacctttgtgagcgattacgttaaccacttctatccgaccccggaagacatcaccggtgataccgagctgcaagcgtgggcgaaggaatgcagcgaccaaagcgcgcagaccaacggtggcaaggtgaaaggcatgccgaccagctttaccaccgtgcaggagctgatcgaaattgttaccaccatcattttcatttgcggtccgcaacacagcgcggttaactacgcgcaggatggctatatgacctttgcggcgaacatgccgctggcggcgtaccgtgacatcccgaagcagagccacaaaccgcaggatcaaccgaccgcgaccccgagcgtggcggttcaaaccaccgcggagcagaccaccgcggaacaaaccaaggcggtggagattaccgcggacaaagcgaccctggatcagaacaccgttctgcaaaaacgtgcggtgcagaccaccaccgttgagatcccggaagaccaaattaccgaggaacagatcctgaagctgctgccgccgtacaaacgtaccgcggaccaactgcagagcctgtttgtgctgagcgcgtaccagtatgatcgtctgggttactatgagaaggcgttccaacagctgtacaacgacaagttcgaagatgttttcaaggacgataacaaccaagcgatcattgcgattgtgcgtcagttccaacagaacctgaacatggttgagcaggaaatcgacgcgaacaacaagaaacgtgtggttccgtacctgtatctgaaaccgagcctgatcctgaacagcatcagcatttaa

SEQ ID NO: 262 - protein, 642 aa, Artificial Sequence
  Amino acid sequence for WP_015204462.1mut3
MPQPCLPQNEPNPEKRNNDLSDQQQAYEYDYKYLPPLVLLKKIPAFENFSAQYIAERVVATSELVPNMLAAKARSFLDPLDDIKDYEDLFTLLPLPEVAKVYQTNNSFAEQRLSGANPFVIRLLDEDDARSQVLEQIPSFKDDFEPLFDVEKELAAGNIYICDYTGTDEYYRGPSMVQGGTYEKGRKYLPKPLAFFWWQRTGISDRGQLVPIAIQLDPSKNSKVYTPTNSKVYTPFEQNPLDWLFAKLCVQIADANHHEMSSHLCRTHFVMEPIAICTAHQLAENHPLSLLLRPHFLFMLTNNSLGQQRLINPGGPVDELLAGTLPESMELVKDAYEGWNIKEFAFPTEIKNRGMDNTERLPHYPYRDDGMLVWKAIHTFVSDYVNHFYPTPEDITGDTELQAWAKECSDQSAQTNGGKVKGMPTSFTTVQELIEIVTTIIFICGPQHSAVNYAQDGYMTFAANMPLAAYRDIPKQSHKPQDQPTATPSVAVQTTAEQTTAEQTKAVEITADKATLDQNTVLQKRAVQTTTVEIPEDQITEEQILKLLPPYKRTADQLQSLFVLSAYQYDRLGYYEKAFQQLYNDKFEDVFKDDNNQAIIAIVRQFQQNLNMVEQEIDANNKKRVVPYLYLKPSLILNSISI

SEQ ID NO: 263 - DNA, 1716 bp, Artificial Sequence
  Codon-optimized coding sequence of WP_006635899.1mut
atggtggataacatgaagccgtgcctgccgcaagacgatccgaacccggaacagcgtcacgacagcctgaaccgtcagcaacaggcgtaccaattcgattatgaaagcctgagcccgctggcgctgctgaaggatgtgccggcggttgagaactttagcagcaaatacctggcggagcgtatcctggcgaccagcgaactgccggcgaacatgctggcggcggacagccgtaccttcctggacccgctggatgagctgcaggactacgaagatttctttacctggctgccgctgccgggtgtggcgaaaatctatcaaaccgatcgtagctttgcggaacagcgtctgagcggtgcgaacccgatggttctgcgtctgctgcaccaagaggacgcgcgtgcggaaaccctggcgcaactgtgctgcctgcagccgctgttcgacctgcgtaaggagctgcaggataaaaacatctacatttgcgactataccggcaccgatgaacactatcgtggtccggcgaaggttgcgggtggcacctacgagaagggtcgtaaatatctgccgaaaccgcgtgcgttctttgcgtggcgttggaccggtatccgtgatcgtggcgagatgaccccgatcgcgattcaactggacccgaagccgggtagccacctgtacaccccgtttgacccgccgattgattggctgtatgcgaaactgtgcgtgcaggttgcggacgcgaaccaccacgaaatgagcagccacctgggccgtacccacctggtgatggagccgatcgcgatttgcaccgcgcgtcagctggcgaagaaccacccgctgagcctgctgctgaaaccgcacttccgttttatgctgaccaacaacagcctggcgcgtagccacctgattgcgccgggtggcccggttgatgaactgctgggtggcaccctggcggagaccatggaactgacccgtgaggcgtgcagcacctggagcctggatgagtttgcgctgccggcggaactgaagaaccgtggtatggacgatccgaaccagctgccgcactacccgtatcgtgacgatggcctgctgctgtgggatgcgatcgaaacctttgtgagcggttacctgaagttcttttatccgaccaacgagggcattgtgcaagacgttgaactgcagacctgggcgaaagagtgcgcgagcgacgatggtggcaaggtgaagggtatgccgcaccacatcgacaccgttgagcagctgatcgcgattgtgaccaccgttattttcacctgcggcccgcaacacagcgcggtgaacttcccgcagtacgattatatgagctttgcggcgaacatgccgctggcggcgtaccgtgacatcccgggtattaccgcgagcggccacctggaagtgatcaccgaaaacgatattctgcgtctgctgccgccgtataagcgtgcggcggaccaactgcagatcctgttcattctgagcgcgtaccgttatgaccgtctgggttactatgataaaagctttcgtgaactgtaccgtatgagcttcgatgaggtttttgcgggcaccccgatccaactgctggcgcgtcagttccaacagaacctgaacatggcggaacaaaagatcgacgcgaacaaccagaaacgtgtgattccgtattttgcgctgaaaccgagcctggttctgaacagcattagcatgtaa

SEQ ID NO: 264 - protein, 571 aa, Artificial Sequence
  Amino acid sequence for WP_006635899.1mut
MVDNMKPCLPQDDPNPEQRHDSLNRQQQAYQFDYESLSPLALLKDVPAVENFSSKYLAERILATSELPANMLAADSRTFLDPLDELQDYEDFFTWLPLPGVAKIYQTDRSFAEQRLSGANPMVLRLLHQEDARAETLAQLCCLQPLFDLRKELQDKNIYICDYTGTDEHYRGPAKVAGGTYEKGRKYLPKPRAFFAWRWTGIRDRGEMTPIAIQLDPKPGSHLYTPFDPPIDWLYAKLCVQVADANHHEMSSHLGRTHLVMEPIAICTARQLAKNHPLSLLLKPHFRFMLTNNSLARSHLIAPGGPVDELLGGTLAETMELTREACSTWSLDEFALPAELKNRGMDDPNQLPHYPYRDDGLLLWDAIETFVSGYLKFFYPTNEGIVQDVELQTWAKECASDDGGKVKGMPHHIDTVEQLIAIVTTVIFTCGPQHSAVNFPQYDYMSFAANMPLAAYRDIPGITASGHLEVITENDILRLLPPYKRAADQLQILFILSAYRYDRLGYYDKSFRELYRMSFDEVFAGTPIQLLARQFQQNLNMAEQKIDANNQKRVIPYFALKPSLVLNSISM

SEQ ID NO: 265 - DNA, 1716 bp, Artificial Sequence
  Codon-optimized coding sequence of WP_015178512.1mut
atggtggacaacatgaagccgtgcctgccgcaagacgatccgaaccaagagcagcgtaaagacagcctgaaccgtcagcaacaggcgtaccagttcgattatgagagcctgagcccgctggcgctgctgaagaacgtgccggcggttgaaaactttagcagcaaatacatcggcgagcgtattctggcgaccagcgaactgccggcgaacatgctggcggcggacagccgtaccttcctggacccgctggatgagctgcaagactacgaagatttctttaccctgctgccgctgccggcggtggcgaagatttatcaaaccgatcgtagctttgcggagcagcgtctgagcggtgcgaacccgatggttctgcgtctgctggatgcgggtgatgcgcgtgcgcaaaccctggcgcagatcagcagcttccacccgctgtttgacctgggccaggaactgcaacagaaaaacatttacgtttgcgactataccggcaccgatgagcactaccgtgcgccgagcaagatcggtggcggtagctatgaaaagggccgtaaattcctgccgaaaccgcgtgcgttctttgcgtggcgttggaccggcatccgtgaccgtggtgaaatgaccccgatcgcgattcaactggacccgaccccggatagccatgtgtacaccccgtttgacccgccggttgattggctgtttgcgaagctgtgcgtgcaggttgcggatgcgaaccaccacgagatgagcagccacctgggtcgtacccacctggtgatggaaccgatcgcgatttgcaccgcgcgtcaactggcgcagaaccacccgctgagcctgctgctgaaaccgcacttccgttttatgctgaccaacaacagcctggcgcgtagctacctgattgcgccgggcggtccggttgatgagctgctgggtggcaccctgccggagaccatggaaatcgcgcgtgaagcgtgcagcacctggagcctggatgagtttgcgctgccggcggaactgaagaaccgtggcatggacgataccaaccagctgccgcactacccgtatcgtgacgatggcctgctgctgtgggacgcgattgagacctttgtgagcggttacctgaaattcttttatccgaccgaaatcgcgattgtgcaagacgttgagctgcaaacctgggcgcaggaatgcgcgagcgatcgtggcggtaaagtgaaaggcatgccgccgcgtatcaacaccgtggagcagctgatcaagattgttaccaccatcattttcacctgcggtccgcaacacagcgcggttaacttcccgcagtacgaatatatgagctttgcggcgaacatgccgctggcggcgtaccgtgatatcccgaagattaccgcgagcggtaacctggaagtgatcaccgaaaaagacattctgcgtctgctgccgccgtataagcgtgcggcggatcagctgaaaatcctgttcaccctgagcgcgtaccgttatgaccgtctgggctactatgataagagctttcgtgagctgtaccgtatgagcttcgacgaagtttttgcgggcaccccgattcaactgctggcgcgtcagtttcaacagaacctgaacatggcggagcaaaagatcgatgcgaacaaccagaaacgtgtgatcccgtatattgcgctgaaaccgagcctggttatcaacagcattagcatgtaa

SEQ ID NO: 266 - protein, 571 aa, Artificial Sequence
  Amino acid sequence for WP_015178512.1mut
MVDNMKPCLPQDDPNQEQRKDSLNRQQQAYQFDYESLSPLALLKNVPAVENFSSKYIGERILATSELPANMLAADSRTFLDPLDELQDYEDFFTLLPLPAVAKIYQTDRSFAEQRLSGANPMVLRLLDAGDARAQTLAQISSFHPLFDLGQELQQKNIYVCDYTGTDEHYRAPSKIGGGSYEKGRKFLPKPRAFFAWRWTGIRDRGEMTPIAIQLDPTPDSHVYTPFDPPVDWLFAKLCVQVADANHHEMSSHLGRTHLVMEPIAICTARQLAQNHPLSLLLKPHFRFMLTNNSLARSYLIAPGGPVDELLGGTLPETMEIAREACSTWSLDEFALPAELKNRGMDDTNQLPHYPYRDDGLLLWDAIETFVSGYLKFFYPTEIAIVQDVELQTWAQECASDRGGKVKGMPPRINTVEQLIKIVTTIIFTCGPQHSAVNFPQYEYMSFAANMPLAAYRDIPKITASGNLEVITEKDILRLLPPYKRAADQLKILFTLSAYRYDRLGYYDKSFRELYRMSFDEVFAGTPIQLLARQFQQNLNMAEQKIDANNQKRVIPYIALKPSLVINSISM

SEQ ID NO: 267 - DNA, 1647 bp, Artificial Sequence
  Codon-optimized coding sequence of WP_028091425.1mut
atgcagccgtgcctgccgcaaaacgacccgaacccgagccagcgtcaaagcagcctggagaagggtcgtaaggaataccagttcatgtacgattttctgccgccgatggcgatgatcaagagcgtgccgccggcggagaacttcagcaccaaatacattgcggaacgtaccctggaggcggcggaactgccgctgaacatgatggcggttaagacccacgcgatgtgggacccgctggatgagctgcaggactacgaagatttctttccggtgctgcaaaagccgaacgttatgaaaacctatgagaccgacgatagctttgcggaacagcgtctgtgcggcgtgaacccgatggttctgcgtcagatcaagcaaatggacgcgcgtttcgcgtttaccattgaggaactgcaagataaattcggtagcagcatcaacctgattgagcgtctggcgaccggcaacctgtacgtgtgcgactatcgtagcctggcgtttatccagggtggcacctacgcgaagggtaagaaatatctgccggcgccgctggcgttcttttgctggcgtaccagcggtttccaggatcgtggccaactggtgccggttgcgatccagattaacccgaaagcgggtaaagcgagcccgctgctgaccccgtttgatgatccgctgacctggttttacgcgaaaagctgcgttcaaatcgcggacgcgaaccaccacgagatgagcagccacctgtgccgtacccacctggtgatggagccgtttgcggtttgcaccccgcgtcagctggcggaaaaccacccgctgcgtattctgctgaagccgcacttccgttttatgctggcgaacaacagcctggcgcgtaaacgtctggttagccgtggtggcttcgttgacgagctgctggcgggcaccctgcaggaaagcctgcaaatcgtggttgacgcgtacaaaagctggagcctggatcagtttgcgctgccgcgtgaactgaagaaccgtggtgtgaacgatgttaaaaacctgccgcactacccgtatcgtgacgatggcatcctgctgtggaacgcgattaacaagttcgtgtttaactatctgcagctgtactatcaaagcagcgcggacctgaaggcggatgcggaactgcaggcgtgggcgcgtgaatgcgtggcgcaagacggtggccgtgttaagggtatgagcgaccgtatcgataccctggagcagctggttgagatcgttaccaccatcatttacatttgcggcccgcagcacagcgcggtgaacttcagccaatacgaatatatgggctttattccgaacatgccgctggcggcgtatcagccgatccagcaaaagggtgacattaaagatcgtcaagcgctgatcgatttcctgccgccggcgaaaccgaccagcacccagctgagcaccgtttacattctgagcgactaccgttatgatcgtctgggctactatgaggaagaggaattcaccgacccgaacgcggatcaggtggttaacaagtttcagcaagagctgaacatggtgcagcgtaagatcgaactgaacaacaaacgtcgtctggttaactacaaatatctgcaaccgcgtctgattctgaacagcatcagcatttaa

SEQ ID NO: 268 - protein, 548 aa, Artificial Sequence
  Amino acid sequence for WP_028091425.1mut
MQPCLPQNDPNPSQRQSSLEKGRKEYQFMYDFLPPMAMIKSVPPAENFSTKYIAERTLEAAELPLNMMAVKTHAMWDPLDELQDYEDFFPVLQKPNVMKTYETDDSFAEQRLCGVNPMVLRQIKQMDARFAFTIEELQDKFGSSINLIERLATGNLYVCDYRSLAFIQGGTYAKGKKYLPAPLAFFCWRTSGFQDRGQLVPVAIQINPKAGKASPLLTPFDDPLTWFYAKSCVQIADANHHEMSSHLCRTHLVMEPFAVCTPRQLAENHPLRILLKPHFRFMLANNSLARKRLVSRGGFVDELLAGTLQESLQIVVDAYKSWSLDQFALPRELKNRGVNDVKNLPHYPYRDDGILLWNAINKFVFNYLQLYYQSSADLKADAELQAWARECVAQDGGRVKGMSDRIDTLEQLVEIVTTIIYICGPQHSAVNFSQYEYMGFIPNMPLAAYQPIQQKGDIKDRQALIDFLPPAKPTSTQLSTVYILSDYRYDRLGYYEEEEFTDPNADQVVNKFQQELNMVQRKIELNNKRRLVNYKYLQPRLILNSISI

SEQ ID NO: 269 - DNA, 1647 bp, Artificial Sequence
  Codon-optimized coding sequence of OBQ01436.1mut
atgcagccgtgcctgccgcaaaacgacccgaacccggcgcagcgtcaaagctgcctggagaagggtcgtaaggaataccagttcatgtacgattttctgccgccgatggcgatgctgaagagcgttccgccggcggagaacttcagcaccaaatacatcgcggaacgtaccctggaggcggcggaactgccgctgaacatgatggcggtgaagacccacgcgatgtgggacccgctggatgagctgcaggactacgaagatttctttccgattctgcaaaagccgaacgttatgaaaacctatgagaccgacgatagctttgcggaacagcgtctgtgcggcgtgaacccgatggttctgcgtcagatcaagcaaatggacgcgcgtttcgcgtttaccattgaggaactgcaagcgaaattcggtaacagcatcaacctgattgagcgtctggcgaccggcaacctgtacgtttgcgattatcgtagcctggcgtttatccagggtggcacctacgcgaagggtaagaaatatctgccggcgccgctggcgttcttttgctggcgtagcagcggtttccaggaccgtggccaactggtgccggttgcgatccagattaacccgaaagcgggtaaagcgagcccgctgctgaccccgtttgatgatccgctgacctggttttacgcgaaaagctgcgtgcaaatcgcggatgcgaaccaccacgagatgagcagccacctgtgccgtacccacctggtgatggagccgtttgcggtttgcaccccgcgtcagctggcggaaaaccacccgctgcgtattctgctgcgtccgcacttccgttttatgctggcgaacaacagcctggcgcgtaagcgtctggttagccgtggtggcttcgttgacgagctgctggcgggcaccctgcaggaaagcctgcaaatcgtggttgacgcgtacaaaagctggagcctggatcagtttgcgctgccgcgtgaactgaagaaccgtggtgtggacgatgttaaaaacctgccgcactacccgtatcgtgacgatggcatcctgctgtggaacgcgattaacaagttcgtgtttaactatctgcagctgtactataagagcccggcggacctgaaggcggatggtgaactgcaggcgtgggcgcgtgaatgcgtggcgcaagacggtggccgtgttaaaggcatgagcgaccgtatcgataccctggagcaactggtggaaatcgttaccaccatcatttacatttgcggcccgcagcacagcgcggtgaacttcagccaatacgagtatatgggctttattccgaacatgccgctggcggcgtatcaggagatccagcaaaacggtgacattgaagatcgtcaagcgctgatcgatttcctgccgccggcgaagccgaccaacacccagctgagcaccgtttacattctgagcgactaccgttatgatcgtctgggctactatgaggaagaggaattcaccgacccgaacgcggatcaggtggttaacaaatttcagcaagagctgagcgtggttcagcgtaagatcgaactgaacaacaaaggtcgtctggtgaactacgaatatctgcaaccgggcctgattctgaacagcatcagcatttaa

SEQ ID NO: 270 - protein, 548 aa, Artificial Sequence
  Amino acid sequence for OBQ01436.1mut
MQPCLPQNDPNPAQRQSCLEKGRKEYQFMYDFLPPMAMLKSVPPAENFSTKYIAERTLEAAELPLNMMAVKTHAMWDPLDELQDYEDFFPILQKPNVMKTYETDDSFAEQRLCGVNPMVLRQIKQMDARFAFTIEELQAKFGNSINLIERLATGNLYVCDYRSLAFIQGGTYAKGKKYLPAPLAFFCWRSSGFQDRGQLVPVAIQINPKAGKASPLLTPFDDPLTWFYAKSCVQIADANHHEMSSHLCRTHLVMEPFAVCTPRQLAENHPLRILLRPHFRFMLANNSLARKRLVSRGGFVDELLAGTLQESLQIVVDAYKSWSLDQFALPRELKNRGVDDVKNLPHYPYRDDGILLWNAINKFVFNYLQLYYKSPADLKADGELQAWARECVAQDGGRVKGMSDRIDTLEQLVEIVTTIIYICGPQHSAVNFSQYEYMGFIPNMPLAAYQEIQQNGDIEDRQALIDFLPPAKPTNTQLSTVYILSDYRYDRLGYYEEEEFTDPNADQVVNKFQQELSVVQRKIELNNKGRLVNYEYLQPGLILNSISI

SEQ ID NO: 271 - DNA, 1659 bp, Artificial Sequence
  Codon-optimized coding sequence of OBQ25779.1mut
atgatcaacattatgcagccgtgcctgccgcaaaacgacccgaacccgggtcagcgtcaaagcagcctggagaagggccgtaaggaataccagttcatgtacgattttctgccgccgatggcgatgctgaagagcgtgccgccggcggagaacttcagcaccaaatacatcgcggaacgtaccctggaggcggcggaactgccgctgaacatgatggcggttaagacccacgcgatgtgggacccgctggatgagctgcaggactacgaagatttctttccggtgctgcaaaagccgaacgttatgaaaacctatgagaccgacgatagctttgcggaacagcgtctgtgcggtgtgaacccgatggttctgcgtcagatcaagcaaatggacgcgcgtttcgcgtttaccattgaggaactgcaagcgaaattcggtaacagcatcaacctgattgagcgtctggcgaccggcaacctgtacgtttgcgattatcgtagcctggcgtttatccagggtggcacctacgcgaagggtaagaaatatctgccggcgccgctggcgttcttttgctggcgtagcagcggtttccaggaccgtggccaactggtgccggttgcgatccagattaacccgaaagcgggtcaagcgagcccgctgctgaccccgtttgacaagccgctgacctggttttacgcgaaaagctgcgtgcagatcgcggatgcgaaccaccacgagatgagcagccacctgtgccgtacccacctggtgatggagccgtttgcggtttgcaccccgcgtcaactggcggaaaaccacccgctgcgtattctgctgaagccgcacttccgttttatgctggcgaacaacagcctggcgcgtaaacgtctggttagccgtggtggcttcgttgacgagctgctggcgggcaccctgcaggaaagcctgcaaatcgtggttgacgcgtacaaaagctggagcctggatcagtttgcgctgccgcgtgaactgaagaaccgtggtgtggacgatgttaaaaacctgccgcactacccgtatcgtgacgatggcatcctgctgtggaacgcgattaacaagttcgtttttaactatctgcagctgtactataagagcccggcggacctgaaggcggatggtgaactgcaggcgtgggcgcgtgaatgcgtggcgcaagacggtggccgtgttaaaggcatgagcgaccgtatcgataccctggagcaactggtggaaatcgttaccaccatcatttacatttgcggcccgcagcacagcgcggtgaacttcagccaatacgagtatatgggctttattccgaacatgccgctggcggcgtatcaggcgatccagcaaaagggcgacattaaagatcgtcaagcgctgatcgatttcctgccgccggcgaagccgaccaacacccagctgagcaccgtttacattctgagcgactaccgttatgatcgtctgggttactatgaggaagaggaattcaccgacccgaacgcggatcaggtggttaacaaatttcagcaagagctgaacgtggttcagcgtaagatcgaactgaacaacaaaggccgtctggtgaactacgaatatctgcagccgcgtctgattctgaacagcatcagcatttaa

SEQ ID NO: 272 - protein, 552 aa, Artificial Sequence
  Amino acid sequence for OBQ25779.1mut
MINIMQPCLPQNDPNPGQRQSSLEKGRKEYQFMYDFLPPMAMLKSVPPAENFSTKYIAERTLEAAELPLNMMAVKTHAMWDPLDELQDYEDFFPVLQKPNVMKTYETDDSFAEQRLCGVNPMVLRQIKQMDARFAFTIEELQAKFGNSINLIERLATGNLYVCDYRSLAFIQGGTYAKGKKYLPAPLAFFCWRSSGFQDRGQLVPVAIQINPKAGQASPLLTPFDKPLTWFYAKSCVQIADANHHEMSSHLCRTHLVMEPFAVCTPRQLAENHPLRILLKPHFRFMLANNSLARKRLVSRGGFVDELLAGTLQESLQIVVDAYKSWSLDQFALPRELKNRGVDDVKNLPHYPYRDDGILLWNAINKFVFNYLQLYYKSPADLKADGELQAWARECVAQDGGRVKGMSDRIDTLEQLVEIVTTIIYICGPQHSAVNFSQYEYMGFIPNMPLAAYQAIQQKGDIKDRQALIDFLPPAKPTNTQLSTVYILSDYRYDRLGYYEEEEFTDPNADQVVNKFQQELNVVQRKIELNNKGRLVNYEYLQPRLILNSISI

SEQ ID NO: 273 - DNA, 1644 bp, Artificial Sequence
  Codon-optimized coding sequence of WP_039200563.1mut
atgaagccgtgcctgccgcagaacgatccgaacccgacccagcgtcaaagcagcctggagaagggccgtaaagagtacgaattccgttatgactttctgccgccgatggcgatgctgaagaacgtgccgccgagcgagaacttcagcaccaaatacattgcggaacgtaccatcgagaccgcggaactgccgagcaacatgatggcggttaaagcgcacgcgatgtgggacccgctggatgagctgcaggactacgaagatttctttccggtgctgcaaaagccgaacgttatgaaaaactatgagaccgacgatagcttcgcggaacagcgtctgtgcggtgtgaacccggtggttctgtgccagattaagcaaatggatgcgcgtttcgcgtttaccatcgaggaactgcaagcgaaatttggtaacagcattgatctgcgtgagcgtctggcgaccggcaacctgtacgtttgcgactatcgtccgctggcgttcatccgtggtggcacctttgcgaagggtaagaaatacctgccggcgccgctggcgttcttttgctggcgtagcagcggtttccaggatcgtggccaactggtgccgatcgcgattcagatcaacccgaaggaaggcaaagcgagcccgctgctgaccccgttcgacgatagcagcacctggttttacgcgaagagctgcgttcaaatcgcggacgcgaaccaccacgagatgagcagccacctgtgccgtacccacttcgtgatggaaccgtttgcggtttgcaccccgcgtcagctggcgcaaaaccacccgctgcgtattctgctgaaaccgcacttccgttttatgctggcgaacaacagcctgggtcgtcagcgtctggtgaaccgtggtggcccggttgatgagctgctggcgggcaccctgcaggaaagcctgcaaattgtggttgacgcgtacaccgattggcgtctggaccaattcgcgctgccgaccgagctgaagaaccgtggtgtggacgatgttaaaaacctgccgcactacccgtatcgtgacgatggcattctgctgtggaacgcgatcaacaagttcgtgttcaactacctggaactgtactacaagagcccggcggatctgaccgcggatgttgaactgcaggcgtgggcgcgtgaatgcgtggcgcaagatggtggccgtgttaagggtatgagcgaccgtattgataccctgaaacagctggttgagatcgttaccaccatcatttacacctgcggtccgctgcacagcgcggtgaacttcccgcagtacgaatatatgggctttatcccgaacatgccgctggcggcgtatcaaccgattaagaaagagggtgtttgcacccgtaaggaactgatcgacttcctgccggcggcgaaaccgaccagcagccagctgaccaccctgtttaccctgagcgcgtaccgttatgatcgtctgggctactatgaggaagaggaattcgaggacccgaacgcggacgatgtggttaacaaatttcagcaagagctgaacgtggttcagcgtaagatcgaactgagcaacaaaggtcgtctggtgaactacgaatatctgcaaccgcgtctgattctgaacagcattagcatctaa

SEQ ID NO: 274 - protein, 547 aa, Artificial Sequence
  Amino acid sequence for WP_039200563.1mut
MKPCLPQNDPNPTQRQSSLEKGRKEYEFRYDFLPPMAMLKNVPPSENFSTKYIAERTIETAELPSNMMAVKAHAMWDPLDELQDYEDFFPVLQKPNVMKNYETDDSFAEQRLCGVNPVVLCQIKQMDARFAFTIEELQAKFGNSIDLRERLATGNLYVCDYRPLAFIRGGTFAKGKKYLPAPLAFFCWRSSGFQDRGQLVPIAIQINPKEGKASPLLTPFDDSSTWFYAKSCVQIADANHHEMSSHLCRTHFVMEPFAVCTPRQLAQNHPLRILLKPHFRFMLANNSLGRQRLVNRGGPVDELLAGTLQESLQIVVDAYTDWRLDQFALPTELKNRGVDDVKNLPHYPYRDDGILLWNAINKFVFNYLELYYKSPADLTADVELQAWARECVAQDGGRVKGMSDRIDTLKQLVEIVTTIIYTCGPLHSAVNFPQYEYMGFIPNMPLAAYQPIKKEGVCTRKELIDFLPAAKPTSSQLTTLFTLSAYRYDRLGYYEEEEFEDPNADDVVNKFQQELNVVQRKIELSNKGRLVNYEYLQPRLILNSISI

SEQ ID NO: 275 - DNA, 1644 bp, Artificial Sequence
  Codon-optimized coding sequence of WP_012407347.1mut
atgaaaccgtgcctgccgcagaacgacccggatccgaccaaacgtcagatcctgctggagcgtaaccaaggcgagtacgaattcgactatgattttctggtgccgatggcgatgctgaagaacgttccgagcattgagaacttcagcaccaaatacatcgcggaacgtaccctggagaccgcggaactgccgattaacatgctggcggtgaagacccgtagcctgtgggacccgctggatgagctgcaggactacgaagattattttccggttctgccgaagccgaacatcattaaaacctaccagagcgacgatagcttctgcgagcaacgtctgtgcggcgcgaacccgtttgtgctgcgtcgtattgaacagatggacgcgcgtttcgcgtttaccatcctggagctgcaagaaaagttcggtgatagcattaacctggttgagaaactggcgaacggcaacctgtacgtgtgcgactatcgtgcgctggcgttcgttaaaggtggcagctacgaacgtggtaagaaatttctgccgaccccgatcgcgttcttttgctggcgtagcagcggtttcagcgaccgtggccagctggtgccgatcgttattcaaatcaacccggcggatggcaagcagagccaactgatcaccccgttcgacgatccgctgacctggtttcacgcgaaactgtgcgtgcagattgcggacgcgaaccaccacgaaatgagcagccacctgtgccgtacccacttcgttatggagccgtttgcgatttgcaccgcgcgtcaactggcggaaaaccacccgctgagcctgctgctgaagccgcacttccgttttatgctggcgaacaacagcctggcgcgtaaacgtctgatcagccgtggtggcccggtggatgagctgctggcgggcaccctgcaggaaagcctgcaaattgtggttaacgcgtacaccgagtggagcctggaccagttcagcctgccgaccgaactgaagaaccgtggtatggacgatccggataacctgccgcactacccgtatcgtgacgatggcctgctgctgtggaacgcgattaagaaatttgttagcgagtatctgcagatctactataagaccccgcaagacctggcggaggatctggaactgcagagctgggtgcaagaatgcgttagccagagcggtggccgtgtgaaaggtattagcgaccgtatcaacaccctggaccaactggtggatattgcgaccgcggttatttttacctgcggtccgcagcatgcggcggttaactacagccaatacgagtatatgacctttatgccgaacatgccgctggcggcgtataaacagatgaccagcgaaggcaccatcccggatcgtaagagcctgctgagcttcctgccgccgagcaaacagaccgcggaccaactgagcattctgtttatcctgagcgcgtaccgttatgatcgtctgggctactatgacgataagttcctggacccggaggcgcaagatgtgctggcgaaatttcagcaagaactgaacgaggcggaacgtgagattgaactgaacaacaagagccgtctgatcaactacaactatctgaaaccgcgtctggtgaccaacagcatcagcgtttaa

SEQ ID NO: 276 - protein, 547 aa, Artificial Sequence
  Amino acid sequence for WP_012407347.1mut
MKPCLPQNDPDPTKRQILLERNQGEYEFDYDFLVPMAMLKNVPSIENFSTKYIAERTLETAELPINMLAVKTRSLWDPLDELQDYEDYFPVLPKPNIIKTYQSDDSFCEQRLCGANPFVLRRIEQMDARFAFTILELQEKFGDSINLVEKLANGNLYVCDYRALAFVKGGSYERGKKFLPTPIAFFCWRSSGFSDRGQLVPIVIQINPADGKQSQLITPFDDPLTWFHAKLCVQIADANHHEMSSHLCRTHFVMEPFAICTARQLAENHPLSLLLKPHFRFMLANNSLARKRLISRGGPVDELLAGTLQESLQIVVNAYTEWSLDQFSLPTELKNRGMDDPDNLPHYPYRDDGLLLWNAIKKFVSEYLQIYYKTPQDLAEDLELQSWVQECVSQSGGRVKGISDRINTLDQLVDIATAVIFTCGPQHAAVNYSQYEYMTFMPNMPLAAYKQMTSEGTIPDRKSLLSFLPPSKQTADQLSILFILSAYRYDRLGYYDDKFLDPEAQDVLAKFQQELNEAEREIELNNKSRLINYNYLKPRLVTNSISV

SEQ ID NO: 277 - DNA, 1659 bp, Artificial Sequence
  Codon-optimized coding sequence of WP_027843955.1mut
atgaaaccgtgcctgccgcagaacgacccgaacccggagaagcgtaaagattggctgaacaaaaaccgtgaggaataccaattcaactttaactatctgagcccgctgccgctgatcgacgatgttccgaacaacgaggcgtttagcccgaagtacctggcggaacgtctgccgctgaccttcggtaaactgagcgcgaacaccctgggcattcgtctgcgtagcttttgggacccgttcgatgagtttcaggactatgaagatttctttccggtgctgccgaccccggaactgctgaagacctaccagaacgacgagtatttcgcggaacaacgtctgagcggtgtgaacccgatggttatccgtagcattaaagagctggacgcgcgtttcgcgtttagcatccgtgatctgcaggcggaattcggcaccagcctgaacctggagcaagaactgaacaacggcaacctgtacatttgcgactataccagcctgagctttgttcgtggtggcagctacctgcgtggtcgtaagagcctgccggcgccgattgcgctgttctgctggcgtaacagcggttattgcgatcgtggcgagctgaccccgatcgcgattcaactggtgccggaactgggcaccggtagccgtattctgaccccgtttgacagccacctgaactggctgtacgcgaaaatctgcatgcaaattgcggatgcgaaccaccacgagatgagcagccacctgtgccacacccacctggtgatggagccgtttgcggtttgcaccgcgcgtcagctggcggaaaaccacccgctgggtctgctgctgcgtccgcacttccgttttatgctgcacaacaacagcctggcgcgtaagaacctgatcaaccagggtggctacgttgacaacctgctgggtggcaccctgcgtgagagcctgcaaattgtgcgtgacgcgtatttcaagaacgcggaggaattttggagcctggatgagttcgcgctgccgaaagaaatcgcgaaccgtggtctggacgataccgatcgtctgccgcactacccgtatcgtgacgatggcatgctgctgtggaacgcgattgaaaagtttgttagcaactacctgagcatctactatccgaacccgggtgacattaaagatgatcgtgagctgcaagcgtgggcggcggaatgcgtggcggcggatggtggccgtgtgaagggcgttccgagccaatttgagaacctgcagcaactgatcgacgtggttaccggtatcatttttacctgcggtccgcagcacagcgcggtgaactacccgcaatacgaatatatggcgtttgttccgaacatgccgctggcgggttatcaggcggtggacagcaacccgaacatggatctgaaaagcctgatggcgttcctgccgccgccgaaccaaaccgcggaccagctgcaaatcatttacggtctgagcgcgtaccgttatgatcgtctgggctactatgaccgtgagtttagcgatccgcacgcggaggaagtggttcgtctgttccagcaagatctgaaccaggttgagcgtaagatcgaactgcgtaacaaaaaccgtctggtggaatataacttcctgaaaccgagcctggttctgaacagcatcagcatttaa

SEQ ID NO: 278 - protein, 552 aa, Artificial Sequence
  Amino acid sequence for WP_027843955.1mut
MKPCLPQNDPNPEKRKDWLNKNREEYQFNFNYLSPLPLIDDVPNNEAFSPKYLAERLPLTFGKLSANTLGIRLRSFWDPFDEFQDYEDFFPVLPTPELLKTYQNDEYFAEQRLSGVNPMVIRSIKELDARFAFSIRDLQAEFGTSLNLEQELNNGNLYICDYTSLSFVRGGSYLRGRKSLPAPIALFCWRNSGYCDRGELTPIAIQLVPELGTGSRILTPFDSHLNWLYAKICMQIADANHHEMSSHLCHTHLVMEPFAVCTARQLAENHPLGLLLRPHFRFMLHNNSLARKNLINQGGYVDNLLGGTLRESLQIVRDAYFKNAEEFWSLDEFALPKEIANRGLDDTDRLPHYPYRDDGMLLWNAIEKFVSNYLSIYYPNPGDIKDDRELQAWAAECVAADGGRVKGVPSQFENLQQLIDVVTGIIFTCGPQHSAVNYPQYEYMAFVPNMPLAGYQAVDSNPNMDLKSLMAFLPPPNQTADQLQIIYGLSAYRYDRLGYYDREFSDPHAEEVVRLFQQDLNQVERKIELRNKNRLVEYNFLKPSLVLNSISI

SEQ ID NO: 279 - DNA, 1644 bp, Artificial Sequence
  Codon-optimized coding sequence of WP_073641301.1mut
atgaaaccgtgcctgccgcagaacgacccggatccgattaagcgtaaatacagcctggagcacaagaaagaggaatatgaattcgaccacgattttctgagcccgatggcgatgctgaaagacgtgccggcggttgagaacttcagcacccgttacattgcggaacgtaccgtggagaccgcggaactgccgatcaacatgctggcggttaagacccgtgcgctgtgggacccgctggatgagctgcaggactacgaagattatttcccggtgctgccgaagccgaacgttatcaaaacctaccagaccgacgatagcttttgcgagcaacgtctgtgcggtgcgaacccgatggcgctgcagcaaatcaaagagatggacgcgcgtttcgaatttaccattgaggaactgcaggagaaattcggtgaaagcatcaacctggtggagaagctggcggacggcaacctgtacgtgtgcgattatcgtccgctgagctttgttaagggtggcacctacgaacgtggtaagaaatatctgccgaccccgctggcgttcttttgctggcgtagcagcggtttcagcgatcgtggccagctggtgccgatcgcgattcaactgaacccggcggttggccgtcagagccaactgattaccccgttcgacgatccgctgacctggtttcacgcgaaactgtgcgtgcagatcgcggacgcgaaccaccacgagatgagcagccacctgtgccgtacccacttcgttatggaaccgtttgcgatttgcaccgcgcgtcaactggcggataaccacccgctgaacctgctgctgaaaccgcacttccgttttatgctggcgaacaacagcctgggtcgtaagcgtctggtgaaccgtggtggcccggttgatgagctgctggcgggcaccctgcaggaaagcctgcaaattgtggttaacgcgtacaaagagtggagcctggatgaattcgcgctgccgaccgaaatcaagaaccgtggtatggacgataagctgaaactgccgcactacccgtatcgtgacgatggcatgctgctgtggaacgcgattaagaaatttgtgagcgagtatctgaagctgtactataaaaccccgcaggacctgaccgcggatctggaactgcaggcgtgggcgcaagagtgcgttagcgaaagcggtggccgtgtgaaaggtgttccgagccgtatcgagaagctggaacaactggtggacatcgcgaccgcggttatttttacctgcggtccgcagcatgcggcggttaactacagccaatacgagtatatgacctttatgccgaacatgccgctggcggcgtataagcagatgaccgcggaaggcaccatcgcggatcgtaaaagcctgctgagcttcctgccgccgagcaagcagaccgcggaccaactgagcatcctgtttattctgagcgcgtaccgttatgatcgtctgggctactatgacgataaattcgcggacccggaggcgcaagatattctggtgacctttcagcaagacctgaacgaggttgagcgtaagatcgaactgaacaacaagagccgtctgattaaatacaactatctgaagccgcgtctggtgaccaacagcatcagcgtttaa

SEQ ID NO: 280 - protein, 547 aa, Artificial Sequence
  Amino acid sequence for WP_073641301.1mut
MKPCLPQNDPDPIKRKYSLEHKKEEYEFDHDFLSPMAMLKDVPAVENFSTRYIAERTVETAELPINMLAVKTRALWDPLDELQDYEDYFPVLPKPNVIKTYQTDDSFCEQRLCGANPMALQQIKEMDARFEFTIEELQEKFGESINLVEKLADGNLYVCDYRPLSFVKGGTYERGKKYLPTPLAFFCWRSSGFSDRGQLVPIAIQLNPAVGRQSQLITPFDDPLTWFHAKLCVQIADANHHEMSSHLCRTHFVMEPFAICTARQLADNHPLNLLLKPHFRFMLANNSLGRKRLVNRGGPVDELLAGTLQESLQIVVNAYKEWSLDEFALPTEIKNRGMDDKLKLPHYPYRDDGMLLWNAIKKFVSEYLKLYYKTPQDLTADLELQAWAQECVSESGGRVKGVPSRIEKLEQLVDIATAVIFTCGPQHAAVNYSQYEYMTFMPNMPLAAYKQMTAEGTIADRKSLLSFLPPSKQTADQLSILFILSAYRYDRLGYYDDKFADPEAQDILVTFQQDLNEVERKIELNNKSRLIKYNYLKPRLVTNSISV

SEQ ID NO: 281 - DNA, 1644 bp, Artificial Sequence
  Codon-optimized coding sequence of WP_096647440.1mut
atgaaaccgtgcctgccgcagaacgacccggagccgacccagcgtaagaacttcctggaacgtaaacagggcgagtacgaattcgatcacaagtttctgaaaccgatggcgatgctgaagaacgtgccgagcattgagaactttagcaccaaatatatcgcggaacgtaccgtggagaccgcggaactgccgctgaacatgctggcggttaaaacccgtagcctgtgggacccgctggatgagctgcaggactacgaagattatttcccggtgctgccgaagccgaacgttatcaaaacctaccagaccgacaacagcttttgcgagcaacgtctgtgcggtgcgaacccgctggttctgcgtcagattcagcaaatggatgcgcgtttcgcgtttaccatcagcgagctgcaagaaaagttcggtgacagcattgatctggaggaacgtctgaaaaccggcaacctgtacgtgtgcgactatcgtgcgctggcgtttgttaagggtggcacctacgagcgtggtaagaaatatctgccgaccccgatcgcgttcttttgctggcgtagcagcggtttcagcgatcgtggccagctggtgccgatcgcgattcaaatcaacccgaccgacggcaagcagagccaactgatcaccccgttcgatgaaccgctggtgtggtttcacgcgaaactgtgcgttcagattgcggacgcgaaccaccacgagatgagcagccacctgtgccgtacccacttcgttatggaaccgtttgcgatttgcaccgcgcgtcagctggcggataaccacccgctgaacctgctgctgaagccgcacttccgttttatgctggcgaacaacagcctgggtcgtcaacgtctggtgaaccgtggtggcccggttgatgagctgctggcgggcaccctgcaggaaagcctgcaaatcgtggttaacgcgtacaaagagtggagcctggatcagttcagcctgccgaccgaactgaagaaccgtggtatggacaacagcgataaactgccgcactacccgtatcgtgacgatggcctgctgctgtggaacgcgattaagaaattcgtgagcgaatacctgaagctgtactataaaaccccgcaagacctgaccgcggattttgagctgcagagctgggcgcaagaatgcgttagccagagcggtggccgtgtgaaaggtgttagcgaccgtatcaccaccctggaccaactgattgatatcgcgaccgcggtgatttttacctgcggtccgcagcatgcggcggttaactacagccaatacgagtatatgacctttatcccgaacatgccgctggcggcgtataagcagattaccagcgagggtaacatcccggaccgtaagagcctgctgagcttcctgccgccgagcaaacagaccgcggatcaactgagcattctgtttatcctgagcgcgtaccgttatgaccgtctgggctactatgacgataaattcctggatccggaggcgcaggaaatcctggtgacctttcagcaagagctgaacgaggcggaacgtcaaattgaactgaacaacaagagccgtctgatcaactacgactatctgaaaccgcgtctggtgaccaacagcattagcgtttaa

SEQ ID NO: 282 - protein, 547 aa, Artificial Sequence
  Amino acid sequence for WP_096647440.1mut
MKPCLPQNDPEPTQRKNFLERKQGEYEFDHKFLKPMAMLKNVPSIENFSTKYIAERTVETAELPLNMLAVKTRSLWDPLDELQDYEDYFPVLPKPNVIKTYQTDNSFCEQRLCGANPLVLRQIQQMDARFAFTISELQEKFGDSIDLEERLKTGNLYVCDYRALAFVKGGTYERGKKYLPTPIAFFCWRSSGFSDRGQLVPIAIQINPTDGKQSQLITPFDEPLVWFHAKLCVQIADANHHEMSSHLCRTHFVMEPFAICTARQLADNHPLNLLLKPHFRFMLANNSLGRQRLVNRGGPVDELLAGTLQESLQIVVNAYKEWSLDQFSLPTELKNRGMDNSDKLPHYPYRDDGLLLWNAIKKFVSEYLKLYYKTPQDLTADFELQSWAQECVSQSGGRVKGVSDRITTLDQLIDIATAVIFTCGPQHAAVNYSQYEYMTFIPNMPLAAYKQITSEGNIPDRKSLLSFLPPSKQTADQLSILFILSAYRYDRLGYYDDKFLDPEAQEILVTFQQELNEAERQIELNNKSRLINYDYLKPRLVTNSISV

SEQ ID NO: 283 - DNA, 1641 bp, Artificial Sequence
  Codon-optimized coding sequence of WP_099099431.1mut
atgaaaccgtgcctgccgcagaaagacccggatgttaaagtgcgtatcaactggctggacaaaaaccgtgaggaatacaagttcaactacgactatctggcgccgctgccggttatcgataaagtgccgcacaaggagatttttagcgcggaatataccaccaaacgtctggcgagcatggcgagcctggcgccgaacatgctggcggcgaaggcgcgtaacttcctggacccgctggatgagctggaggaatacgaggaactgctgagcctgctgccgaagccggacgttatcaagaactataaaaccgatagctgctttgcggaacaacgtctgagcggtgcgaacccgctggcgatccaaaaaattgacgttctggatgcgcgtttcgcggtgaccgacgcgcactttcagaaggtggcgggcaccgagttcaccctggaaaaggcgctgaaagagggcaagctgtacttttgcgactatccgctgctgagcgatatcaaaggtggcgtttacaacaacgtgaagaaatatctgccgaagccgcaggcgctgttctactggcaaagcaacgacagcccgaacggtggcagcctggttccggtggcgatccagattaaccacgatagcggtggcaaaagcgttatctataccccggacgatccgcacctggactggtttctggcgaagacctgcgtgcagattgcggatggtaaccaccaagagctgggcagccacttcgcgtacacccacgcggttatggcgccgtttgcgatctgcaccgcgcgtcaactggcggaaaaccacccgattgcgctgctgctgaaaccgcacttccgttttatgctgttcgacaacagcctgggtcgtacccagtttctgcaaccgggtggcccggttgatgagttcatggcgggtagcctggcggaaagcctgggctttgttgcgaaggtgtacgaggaatggagcgtggagaaattcacctttccgcgtctgatcaagagccgtcgtaccgacgatccggaaattctgccgcacttcccgtttcgtgacgatggtatgctgatctggaacgcggttgagaaattcgtgtacgaatatctgcagctgtactataagaccagccaagacctgattgacgattatgagctgcagaactgggcgcgtgaatgcgttgcgcaagatggtggccgtgtgaaaggcatgccggcgaagatcgagaccctggaacagctgattgagatcattagcgtggttgtttttacctgcgcgccgctgcacagcgcgctgaacttcagccaatacgaatatatggcgtttgttccgaacatgccgtacgcggcgtatcacccgatcccggagaccaaaggtgtggacctggaaaccatcatgaaaattctgccgccgttcaagcaggcggcggaccaagtgatgtggaccgagattctgaccagctaccactatgataagctgggcttctacgacgaggaatttgcggatccgctggcgcaggaaatcgttgtgcaattccagcaaaacctgcacgagattgaacgtcagatcgatattcgtaaccaaacccgtccgatcccgtacaactattttaaaccgagccagatcattaacagcattaacacctaa

SEQ ID NO: 284 - protein, 546 aa, Artificial Sequence
  Amino acid sequence for WP_099099431.1mut
MKPCLPQKDPDVKVRINWLDKNREEYKFNYDYLAPLPVIDKVPHKEIFSAEYTTKRLASMASLAPNMLAAKARNFLDPLDELEEYEELLSLLPKPDVIKNYKTDSCFAEQRLSGANPLAIQKIDVLDARFAVTDAHFQKVAGTEFTLEKALKEGKLYFCDYPLLSDIKGGVYNNVKKYLPKPQALFYWQSNDSPNGGSLVPVAIQINHDSGGKSVIYTPDDPHLDWFLAKTCVQIADGNHQELGSHFAYTHAVMAPFAICTARQLAENHPIALLLKPHFRFMLFDNSLGRTQFLQPGGPVDEFMAGSLAESLGFVAKVYEEWSVEKFTFPRLIKSRRTDDPEILPHFPFRDDGMLIWNAVEKFVYEYLQLYYKTSQDLIDDYELQNWARECVAQDGGRVKGMPAKIETLEQLIEIISVVVFTCAPLHSALNFSQYEYMAFVPNMPYAAYHPIPETKGVDLETIMKILPPFKQAADQVMWTEILTSYHYDKLGFYDEEFADPLAQEIVVQFQQNLHEIERQIDIRNQTRPIPYNYFKPSQIINSINT

SEQ ID NO: 285 - DNA, 1632 bp, Artificial Sequence
  Codon-optimized coding sequence of WP_052672367.1mut
atgaaaccgtgcctgccgcaacatgagccggatgcgattgcgcgtcagaaccgtctgattaaaaaccgtgcggactacgtgctggattacaactatctgccgccgatcccgctgcagaccccggttccgcagcaagagcgtttcagcgcggaatataccgcgcgtcgtctggcgagctttgcgaacctggtgccgaacatgctgatggcgcgtgcgcgtaacgcgtttgacccgctggataccctggaggaatatgcggacctgctgccggtgctgccgaagccgaacgttattaaaaactatcaagcggattggtgcttcgcggagcagcgtctgagcggtatcaacccgccggcgatccgtcgtattgacgcgctggatgcgcgtctgccgattagcaacagcagctttcaacacagcgttggcgcggagcacaacctggaacaggcgctgaaggaaggtaaactgtactgctgcgactatccgctgctgagcggcatcggtggcggtaactaccaaaacctgccgaagtatctgccgaaaccgcaggcgctgttttactggcgtagcgataacagcaagattggcggtagcctggtgccggttgcgatcaagattctgaacgagctgggcggtaaaaacctggtgtacaccccgaacgacgcgccgctggattggttcctggcgaagacctgcgttcagatggcggacgcgaaccaccaagaactgggcacccactttgcgaaaacccacgcggttatggcgccgattgcggcgtgcaccgcgcgtgagctgggtgaaaaccacccgctgaccctgctgctgaaaccgcacttccgttttatgctgttcgataacagcctgggtcgtacccagtttctgcaaccgaccggtccgaccgaggaactgctggcgggcaccctggaggaaagcgttcagctggttgtgcaagcgtacgaggaatggagcatcgacaccaccttcccgctggagctgcagcaacgtcaaatgcacgatccggaaattctgccgcactatccgttccgtgacgatggcatcctggtgtggaacgcgattcaccagtttgttaccgaatacctgcaaatttactatcacaccccgcaggacatcagcgcggattatgaggtgcagaactgggcgcgtgaatgcgtggacagcggtcgtgttaagggtatgccggagagcatcgacaccctggcgcaactgattgatatcattgcggtggttatcttcacctgcgcgccgctgcacagctgcctgaacctggcgcagtacgaatatatgacctttgttccgaacatgccgtacgcggcgtatcacccgatcccgaccaccaagggtgtggatatggcgaccatcgttaaaattatgccgccattccagcgtgcgatcgaccaaattctgtggaccgatattctgagcgcgtttcaatacgacaagctgggcttctatgaggaagactttgcggatccgaaagcgcaggaagtgctgcagcgtttccaagataacctgcagcaagttgaggaaaagatcgaaatgcacaaccagatccgtccgattccgtacaactatctgaaaccgagccgtatcatgaacagcattaacacctaa

SEQ ID NO: 286 - protein, 543 aa, Artificial Sequence
  Amino acid sequence for WP_052672367.1mut
MKPCLPQHEPDAIARQNRLIKNRADYVLDYNYLPPIPLQTPVPQQERFSAEYTARRLASFANLVPNMLMARARNAFDPLDTLEEYADLLPVLPKPNVIKNYQADWCFAEQRLSGINPPAIRRIDALDARLPISNSSFQHSVGAEHNLEQALKEGKLYCCDYPLLSGIGGGNYQNLPKYLPKPQALFYWRSDNSKIGGSLVPVAIKILNELGGKNLVYTPNDAPLDWFLAKTCVQMADANHQELGTHFAKTHAVMAPIAACTARELGENHPLTLLLKPHFRFMLFDNSLGRTQFLQPTGPTEELLAGTLEESVQLVVQAYEEWSIDTTFPLELQQRQMHDPEILPHYPFRDDGILVWNAIHQFVTEYLQIYYHTPQDISADYEVQNWARECVDSGRVKGMPESIDTLAQLIDIIAVVIFTCAPLHSCLNLAQYEYMTFVPNMPYAAYHPIPTTKGVDMATIVKIMPPFQRAIDQILWTDILSAFQYDKLGFYEEDFADPKAQEVLQRFQDNLQQVEEKIEMHNQIRPIPYNYLKPSRIMNSINT

SEQ ID NO: 287 - DNA, 1641 bp, Artificial Sequence
  Codon-optimized coding sequence of WP_073631249.1mut
atgaaaccgtgcctgccgcagcatgacccgaacccggaagcgcgtcgtaactggctggaacaaaaccgtgaggactacaagtttgatcacaactatctggcgccgatcccgattctggacaaggttccgcacaaagagctgttcagcccgcagtacaccgcgaaacgtctggcgagcatggcggatctggtgccgaacatgctggcggcgaaggcgcgtaacttctttgacccgctggatgaactggaggaatacgaggcgctgctgagcattctgccgaaaccgagcgttatcaagaactataaaaccgacagctgctttgcggaacagcgtctgagcggtgcgaacccgatggcgatgcaccgtattgacgagctggatgcgcgtttcccggttaccaacgatcactttcaaaaggcggtgggtgcggaacacaacctggaggcggcgctgaaggaaggcaaactgtacctgtgcgactatccgctgctgtttgatattaagggtggcacctaccagaacatcaagaaatatctgccgaaaccgcaggcgctgttctactggcaaagcaacggtaacaagaacagcggcagcctggtgccgatcgcgattcaaatccacaacgacaccggtggcgatagcctgatttataccccggacgatccgcacctggactggttcctggcgaaaacctgcgttcagatcgcggatgcgaaccaccaagaactgggtagccattttgcgcgtacccatgcggtgatggcgccgtttgcgatctgcaccgcgcgtcaactgggtgaaaaccacccgctggcgctgctgctgaaaccgcacttccgttttatgctgtacgacaacagcctgggtcgtacccacttcctgcaggcgggtggcccggttgatgaatttatggcgggcaccctgcaagagagcctgggctttgtggcgaaggcgtacgaggaatggagcctggacaacgcggttttcccgaccgaggtgaagaaccgtaaaatggacgatccggacattctgccgcactatccgtttcgtgacgatggtatgctgctgtgggatgcggttaagaaattcgtgaccgaatacctgcagctgtactataagaccccgcaagacctgagcgaggattatgaactgcaaaactgggcgcgtgagtgcgcggcgcaagacggtggctgcgttaagggcatgccggagaaaattgaaaccatcgagcagctgatccacgtggttaccgtggttgtgtttacctgcgcgccgctgcacagcgcgctgaacttcagccaatacgaatatatggcgtttgttccgaacatgccgtacgcggcgtactatccggttccggagaccaaaggtgtggatatgcagaccattatgaagatgctgccgccgttcaaacaggcggcggaccaagtgatgtggagcgatatcctgaccagcttccactacgacaagctgggccactatgatgaggaatttgcgaacccgatggcgcaggcgatcctgctgcaattccagcaaaacctgcacgaggtggaacgtcagattgaaatcaagaaccaaagccgtccgattccgtacaactatctgaaaccgagcgagatcattaacagcatcaacacctaa

SEQ ID NO: 288 - protein, 546 aa, Artificial Sequence
  Amino acid sequence for WP_073631249.1mut
MKPCLPQHDPNPEARRNWLEQNREDYKFDHNYLAPIPILDKVPHKELFSPQYTAKRLASMADLVPNMLAAKARNFFDPLDELEEYEALLSILPKPSVIKNYKTDSCFAEQRLSGANPMAMHRIDELDARFPVTNDHFQKAVGAEHNLEAALKEGKLYLCDYPLLFDIKGGTYQNIKKYLPKPQALFYWQSNGNKNSGSLVPIAIQIHNDTGGDSLIYTPDDPHLDWFLAKTCVQIADANHQELGSHFARTHAVMAPFAICTARQLGENHPLALLLKPHFRFMLYDNSLGRTHFLQAGGPVDEFMAGTLQESLGFVAKAYEEWSLDNAVFPTEVKNRKMDDPDILPHYPFRDDGMLLWDAVKKFVTEYLQLYYKTPQDLSEDYELQNWARECAAQDGGCVKGMPEKIETIEQLIHVVTVVVFTCAPLHSALNFSQYEYMAFVPNMPYAAYYPVPETKGVDMQTIMKMLPPFKQAADQVMWSDILTSFHYDKLGHYDEEFANPMAQAILLQFQQNLHEVERQIEIKNQSRPIPYNYLKPSEIINSINT

SEQ ID NO: 289 - DNA, 1620 bp, Artificial Sequence
  Codon-optimized coding sequence of WP_013220336.1mut
atgaacacctgcctgccgcagaacgacagcgatccgcaaggtcgtaaggatcgtctggaacgtcgtcgtgcgctgtacgtgttcaactacgattatgttccgccgatcccgatgattgacaaggttccgcacgaggaatactttagcccgaaatataccgcggagcgtctggcgagcatggcgaaactggcgccgaacatgctggcggcgaagaccaaacgtctgttcgatccgctggacgagctgaacgaatacgatgagatgttcatctttctggacaagccgggtattgttcgtggctatcgtaccgacgaaagcttcggcgagcagcgtctgagcggcgtgaacccgatgagcatccgtcgtctggataaactggacgcgcgttttccgattatggatgaatacctggagcagagcctgggtagcccgcacaccctggcgcaggcgctgcaagaaggccgtctgtacttctgcgactatccgcaactggcgcacgttaaagagggtggtctgtaccgtggtcgtaagaaatatctgccgaaaccgcgtgcgctgttttgctgggatggtaaccacctgcagccggtggcgatccagattagcggccaaccgggtggccgtctgttcattccgcgtgacagcgatctggactggtttgtggcgaagctgtgcgttcagatcgcggacgcgaaccaccaagaactgggcacccacttcgcgcgtacccacgtggttatggcgccgtttgcggtttgcacccatcgtcagctggcggagaaccacccgctgcacattctgctgcgtccgcacttccgttttatgctgtacgataacagcctgggtcgtacccgtttcatccagccggatggtccggtggaacacatgatggcgggcaccctggaggaaagcatcggcattagcgcggcgttctacaaggaatggcgtctggatgaggcggcgtttccgatcgagattgcgcgtcgtaaaatggacgatccggaagttctgccgcactacccgttccgtgacgatggtatgctgctgtgggacggcattcagaagtttgttaaagagtatctggcgctgtactatcaaagcccggaagatctggtgcaggaccaagagctgcgtaactgggcgcgtgaatgcaccgcgaacgatggtggccgtgtggcgggtatgccgggtcgtatcgaaaccgttgaccagctgaccagcatcctgagcaccgtgatttatacctgcgcgccgctgcacagcgcgctgaactttgcgcaatacgagtatatcggttatgttccgaacatgccgtacgcggcgtatcacccgattccggaggaaggtggcgtggatatggagaccctgatgaagattctgccgccgtacgaacaggcggcgctgcaactgaaatggaccgagatcctgaccagctaccactatgaccgtctgggccactatgatgaaaagttcgaggacccgcaggcgcaagcggtggttgaacagtttcagcaagagctggcggcggtggagcaagaaattgatcagcgtaaccaagaccgtccgctggcgtacacctatctgaaaccgagcgaaatcattaacagcatcaacacctaa

SEQ ID NO: 290 - protein, 539 aa, Artificial Sequence
  Amino acid sequence for WP_013220336.1mut
MNTCLPQNDSDPQGRKDRLERRRALYVFNYDYVPPIPMIDKVPHEEYFSPKYTAERLASMAKLAPNMLAAKTKRLFDPLDELNEYDEMFIFLDKPGIVRGYRTDESFGEQRLSGVNPMSIRRLDKLDARFPIMDEYLEQSLGSPHTLAQALQEGRLYFCDYPQLAHVKEGGLYRGRKKYLPKPRALFCWDGNHLQPVAIQISGQPGGRLFIPRDSDLDWFVAKLCVQIADANHQELGTHFARTHVVMAPFAVCTHRQLAENHPLHILLRPHFRFMLYDNSLGRTRFIQPDGPVEHMMAGTLEESIGISAAFYKEWRLDEAAFPIEIARRKMDDPEVLPHYPFRDDGMLLWDGIQKFVKEYLALYYQSPEDLVQDQELRNWARECTANDGGRVAGMPGRIETVDQLTSILSTVIYTCAPLHSALNFAQYEYIGYVPNMPYAAYHPIPEEGGVDMETLMKILPPYEQAALQLKWTEILTSYHYDRLGHYDEKFEDPQAQAVVEQFQQELAAVEQEIDQRNQDRPLAYTYLKPSEIINSINT

The invention claimed is:

1. A method for preparing at least one mono- or polyunsaturated aliphatic aldehyde, which method comprises (1) contacting at least one polyunsaturated fatty acid (PUFA) substrate with a polypeptide which comprises the enzymatic activity of a lipoxygenase, thereby converting said at least one PUFA substrate to a reaction product comprising at least one mono- or polyunsaturated aliphatic aldehyde; and (2) isolating at least one mono- or polyunsaturated aliphatic aldehyde as obtained in step (1);

wherein said PUFA is selected from $C_{16}$-$C_{22}$, wherein the polypeptide comprises an amino acid sequence selected from the group consisting of:

a) SEQ ID NO: 3, 6, 9, 12 or 15, b) SEQ ID NO: 18, and c) amino acid sequences having at least 90% sequence identity to at least one of the sequences of a) or b) and retaining said enzymatic activity of a lipoxygenase.

2. The method of claim 1, wherein the polypeptide comprises the enzymatic activity of a bifunctional lipoxygenase.

3. The method of claim 1, wherein said at least one mono- or polyunsaturated aliphatic aldehyde is a decadienal or a decatrienal, wherein said decadienal is selected from 2E,4E-decadienal and 2E,4Z-decadienal and mixtures thereof; and wherein said decatrienal is selected from 2E,4E, 7Z-decatrienal and 2E,4Z,7Z-decatrienal and mixtures thereof.

4. The method of claim 1, wherein step (1) is performed in vivo in cell culture in the presence of oxygen, or in vitro in a liquid reaction medium in the presence of oxygen.

5. The method of claim 1, wherein step (1) is carried out by cultivating a non-human host organism or cell expressing at least one of said polypeptides having the enzymatic activity of a lipoxygenase in the presence of a PUFA substrate under conditions conducive to the peroxidation and subsequent cleavage of at least one PUFA.

6. The method of claim 1, wherein said PUFA substrate is an isolated PUFA compound or a natural or synthetic composition comprising at least one PUFA convertible by said lipoxygenase.

7. The method of claim 1, which further comprises a chemical or enzymatic isomerization of an obtained mono- or polyunsaturated aliphatic aldehyde; or a chemical or enzymatic conversion of an obtained mono- or polyunsaturated aliphatic aldehyde to the corresponding alcohol or hydrocarbyl ester.

8. The method of claim 1, wherein the polypeptide comprises an amino acid sequence selected from the group consisting of:

a) SEQ ID NO: 3, 6, 9, 12 or 15;

b) SEQ ID NO: 18;

and c) amino acid sequences having at least 95% sequence identity to at least one of the sequences of a) or b) and retaining said enzymatic activity of a lipoxygenase.

* * * * *